United States Patent
Rodrigues et al.

(10) Patent No.: US 11,827,710 B2
(45) Date of Patent: Nov. 28, 2023

(54) ANTIBODIES THAT BIND TO C-TYPE LECTIN DOMAIN FAMILY 2 MEMBER D (CLEC2D)

(71) Applicant: Zumutor Biologies Inc., Cambridge, MA (US)

(72) Inventors: Kavitha Iyer Rodrigues, Bangalore (IN); Maloy Ghosh, Bangalore (IN); Sunit Maity, Bangalore (IN); Yogendra Manjunath Bangalore Muniraju, Bangalore (IN); Sathyabalan Murugesan, Bangalore (IN); Sanghamitra Bhattacharjee, Bangalore (IN); Vivek Halan, Bangalore (IN); Subhra Prakash Chakrabarty, Bangalore (IN); Ashvini Kumar Dubey, Bangalore (IN); Anurag Tiwari, Bangalore (IN); Kirthana Mysore Vasudevarao Sindhe, Bangalore (IN); Pallavi Lahiri, Bangalore (IN); Sahana Bhima Rao, Bangalore (IN); Prachi, Bangalore (IN); Shruti Srivastava, Bangalore (IN); Rao Shreesha Ramesh, Bangalore (IN); Bharath Ravindra Shenoy, Bangalore (IN); Nikitha Markanda, Bangalore (IN); Bhagyashree Dikey, Bangalore (IN); Bairavabalakumar Natarajan, Bangalore (IN)

(73) Assignee: Zumutor Biologics Inc., Cambridge, MA (US)

( * ) Notice: Subject to any disclaimer, the term of this patent is extended or adjusted under 35 U.S.C. 154(b) by 298 days.

(21) Appl. No.: 16/786,391

(22) Filed: Feb. 10, 2020

(65) Prior Publication Data
US 2020/0291120 A1    Sep. 17, 2020

(30) Foreign Application Priority Data
Feb. 11, 2019   (IN) .............................. 201941005395

(51) Int. Cl.
| C07K 16/28 | (2006.01) |
| A61P 35/00 | (2006.01) |
| C12N 5/071 | (2010.01) |
| C12N 15/10 | (2006.01) |
| A61K 39/00 | (2006.01) |

(52) U.S. Cl.
CPC .......... *C07K 16/2851* (2013.01); *A61P 35/00* (2018.01); *C12N 5/0602* (2013.01); *C12N 15/1055* (2013.01); *A61K 2039/505* (2013.01); *C07K 2317/41* (2013.01); *C07K 2317/55* (2013.01); *C07K 2317/565* (2013.01); *C07K 2317/622* (2013.01); *C07K 2317/734* (2013.01); *C07K 2317/92* (2013.01)

(58) Field of Classification Search
CPC ............ C07K 16/2851; C07K 2317/41; C07K 2317/55; C07K 2317/565; C07K 2317/622; C07K 2317/734; C07K 2317/92; A61P 35/00; C12N 5/0602; C12N 5/1055; A61K 2039/505
See application file for complete search history.

(56) References Cited

U.S. PATENT DOCUMENTS

| 4,816,567 A | 3/1989 | Cabilly et al. |
| 4,946,778 A | 8/1990 | Ladner et al. |
| 5,091,513 A | 2/1992 | Huston et al. |
| 5,132,405 A | 7/1992 | Huston et al. |
| 5,202,238 A | 4/1993 | Fell, Jr. et al. |
| 5,204,244 A | 4/1993 | Fell et al. |
| 7,147,854 B2 | 12/2006 | Ye |

FOREIGN PATENT DOCUMENTS

WO    WO 95/22618 A1    8/1995

OTHER PUBLICATIONS

Paul, WE (1993) Fundamental Immunology, 3rd ed. Raven Press, NY, Chap. 9, pp. 292-295.*
Rudikoff, S et al. (1982) Proc. Natl. Acad. Sci. USA, 79:1979-1983.*
Colman, PM (1994) Research in Immunology, Elsevier, NY, 145(1):33-36.*
Boerner et al., "Production of antigen-specific human monoclonal antibodies from in vitro-primed human splenocytes," J. Immunol., (1991) 147: 86-95.
Brüggemann et al., "Designer mice: the production of human antibody repertoires in transgenic animals," Year Immunol., (1993) 7: 33-40.
Clothia et al., "Domain association in immunoglobulin molecules. The packing of variable domains," J. Mol. Biol. (1985) 186:651-663.
Davidson et al., "A model system for in vivo gene transfer into the central nervous system using an adenoviral vector," Nature Genetics, (1993) 3:219-223.
Davis et al., "SEEDbodies: fusion proteins based on strand-exchange engineered domain (SEED) CH3 heterodimers in an Fc analogue platform for asymmetric binders or immunofusions and bispecific antibodies," Protein Eng Des Sel., 2010, 23(4):195-202.
Ford et al., "Fusion tails for the recovery and purification of recombinant proteins," Protein Expression and Purification, (1991) 2:95-107.

(Continued)

*Primary Examiner* — Robert S Landsman
(74) *Attorney, Agent, or Firm* — COOLEY LLP; Chen Chen; Edith Hang Yu Cheng

(57) ABSTRACT

The present disclosure relates to novel anti-CLEC2D antibodies and related compositions and methods of use thereof. These antibodies are used as therapeutics, and in prognostic and diagnostic applications in various cancers and other diseases.

19 Claims, 99 Drawing Sheets
Specification includes a Sequence Listing.

(56) References Cited

OTHER PUBLICATIONS

Geller et al., "An HSV-1 vector expressing tyrosine hydroxylase causes production and release of L-dopa from cultured rat striatal cells," J. Neurochem, (1995) 64(2):487-496.

Geller et al., "Infection of cultured central nervous system neurons with a defective herpes simplex virus 1 vector results in stable expression of *Escherichia coli* ß-galactosidase," PNAS USA, Feb. 1990, 87:1149-1153.

Geller et al., "Long-term increases in neurotransmitter release from neuronal cells expressing a constitutively active adenylate cyclase from a herpes simplex virus type 1 vector," PNAS USA, (1993) 90:7603-7607.

Germain et al., "Induction of Lectin-like Transcript 1 (LLT1) Protein Cell Surface Expression by Pathogens and Interferon-$\gamma$ Contributes to Modulate Immune Responses," The Journal of Biological Chemistry, Nov. 2011, 286, 37964-37975.

Gramer et al., "Production of stable bispecific IgG1 by controlled Fab-arm exchange," mAbs, 2013 5:6, 962-973.

Grussenmeyer et al., "Complexes of polyoma virus medium T antigen and cellular proteins," PNAS USA, Dec. 1985, 82:7952-7954.

Gunasekaran et al., "Enhancing Antibody Fc Heterodimer Formation through Electrostatic Steering Effects: Applications to Bispecific Molecules and Monovalent IgG," J Biol Chem., Jun. 2010, 285(25):19637-19646.

Hopp et al., "A Short Polypeptide Marker Sequence Useful for Recombinant Protein Identification and Purification," Bio/technology, Oct. 1988, 6:1204-1210.

Jakobovits et al., "Analysis of homozygous mutant chimeric mice: deletion of the immunoglobulin heavy-chain joining region blocks B-cell development and antibody production," PNAS USA, Mar. 1993, 90: 2551-2555.

Jakobovits et al., "Germ-line transmission and expression of a human-derived yeast artificial chromosome," Nature (1993) 362: 255-258.

Jansen et al., "Immunotoxins: Hybrid Molecules Combining High Specificity and Potent Cytotoxicity," Immunological Reviews 62:185-216 (1982).

Kaplitt et al., "Long-term gene expression and phenotypic correction using adeno-associated virus vectors in the mammalian brain," Nat. Genet., (1994) 8:148-154.

Killen and Lindstrom, "Specific killing of lymphocytes that cause experimental autoimmune myasthenia gravis by ricin toxin-acetylcholine receptor conjugates," The Journal of Immunology, (1984) 133:2549-2553.

Klein et al., "Progress in overcoming the chain association issue in bispecific heterodimeric IgG antibodies," mAbs, 2012, 4:6, 653-663.

Kontermann et al., "Complement recruitment using bispecific diabodies," Nat Biotechnology, 1997, 15(7):629-631.

Kozbor et al., "A human hybrid myeloma for production of human monoclonal antibodies," J. Immunol., (1984) 133:3001-3005.

Le Gal La Salle et al., "An adenovirus vector for gene transfer into neurons and glia in the brain," Science, (1993) 259:988-990.

Lefranc, M-P., "Nomenclature of the Human Immunoglobulin Genes," Current Protocols in Immunology (2000), vol. 40, Appendix IP A.1P.1-A.1P.37.

Li et al., "Selective killing of cancer cells by $\beta$-lapachone: Direct checkpoint activation as a strategy against cancer," PNAS, Mar. 2003, 100(5): 2674-2678.

Marasco et al., "Design, intracellular expression, and activity of a human anti-human immunodeficiency virus type 1 gp120 single-chain antibody," PNAS USA, Aug. 1993, 90:7889-7893.

Mathew et al., "Overexpression of LLT1 (OCIL, CLEC2D) on prostate cancer cells inhibits NK cell-mediated killing through LLT1-NKRP1A (CD161) interaction," Oncotarget, 2016, vol. 7, No. 42, pp. 68650-68661.

Moore et al., "Application of dual affinity retargeting molecules to achieve optimal redirected T-cell killing of B-cell lymphoma," Blood, Apr. 2011, 117(17):4542-4551.

Morrison et al., "Chimeric human antibody molecules: mouse antigen-binding domains with human constant region domains," PNAS USA, Nov. 1984, 81: 6851-6855.

Morrison, SL, "Success in specification," Nature (1994) 368: 812-813.

Munson and Rodbard, "Ligand: A versatile computerized approach for characterization of ligand-binding systems," Anal. Biochem., (1980) 107:220-239.

Neuberger et al., "A hapten-specific chimaeric IgE antibody with human physiological effector function," Nature (1985) 314: 268-270.

Nilsson et al., "Expression and Purification of Recombinant Insulin-like Growth Factors from *Escherichia coli*," Methods Enzymol. (1991) 198:3-16 (1991).

Nilsson et al., "Immobilization and purification of enzymes with staphylococcal protein A gene fusion vectors," The EMBO Journal, (1985) 4(4):1075-1080.

Novotný and Haber, "Structural invariants of antigen binding: comparison of immunoglobulin VL-VH and VL-VL domain dimers," PNAS USA, Jul. 1985, 82:4592-4596.

Pörtner et al., "T and NK cells of B cell NHL patients exert cytotoxicity against lymphoma cells following binding of bispecific tetravalent antibody CD19 × CD3 or CD19 × CD16," Cancer Immunology Immunotherapy, 2012, 61(10):1869-1875.

Ridgway et al., "'Knobs-into-holes' engineering of antibody CH3 domains for heavy chain heterodimerization," Protein Eng. 1996 9(7):617-621.

Riechmann et al., "Reshaping human antibodies for therapy," Nature (1988) 332: 323-327.

Roy et al., "Protein Interaction Z Score Assessment (PIZSA): an empirical scoring scheme for evaluation of protein-protein interactions," Nucleic Acids Research, 2019, vol. 47, Issue W1, pp. W331-W337.

Rozbeský et al., "Nkrp1 Family, from Lectins to Protein Interacting Molecules," Molecules 2015, 20(2), 3463-3478.

Smith and Johnson, "Single-step purification of polypeptides expressed in *Escherichia coli* as fusions with glutathione S-transferase," Gene, (1988) 67:31-40.

Vitetta et al., "Redesigning nature's poisons to create anti-tumor reagents," Science, (1987) 238:1098-1104.

Von Kreudenstein et al., "Improving biophysical properties of a bispecific antibody scaffold to aid developability, Quality by molecular design," mAbs, 2013, 5:5, 646-654.

Wolf et al., "BiTEs: bispecific antibody constructs with unique anti-tumor activity," Drug Discovery Today, 2005, 10(18):1237-44.

Yang et al., "Cellular and Humoral Immune Responses to Viral Antigens Create Barriers to Lung-Directed Gene Therapy with Recombinant Adenoviruses," J. Virol., Apr. 1995, 69(4):2004-2015.

\* cited by examiner

| Lane no | Samples |
|---|---|
| 1 | 1 kb ladder |
| 2 | Undigested |
| 3-12 | Clone 1 to 10 digested with HindIII/AscI |
| 13 | 100bp ladder |

| Lane no | Samples |
|---|---|
| 1 | 1 kb ladder |
| 2 | Undigested |
| 3-12 | Clone 1 to 10 digested with NcoI/NotI |
| 13 | 100bp ladder |

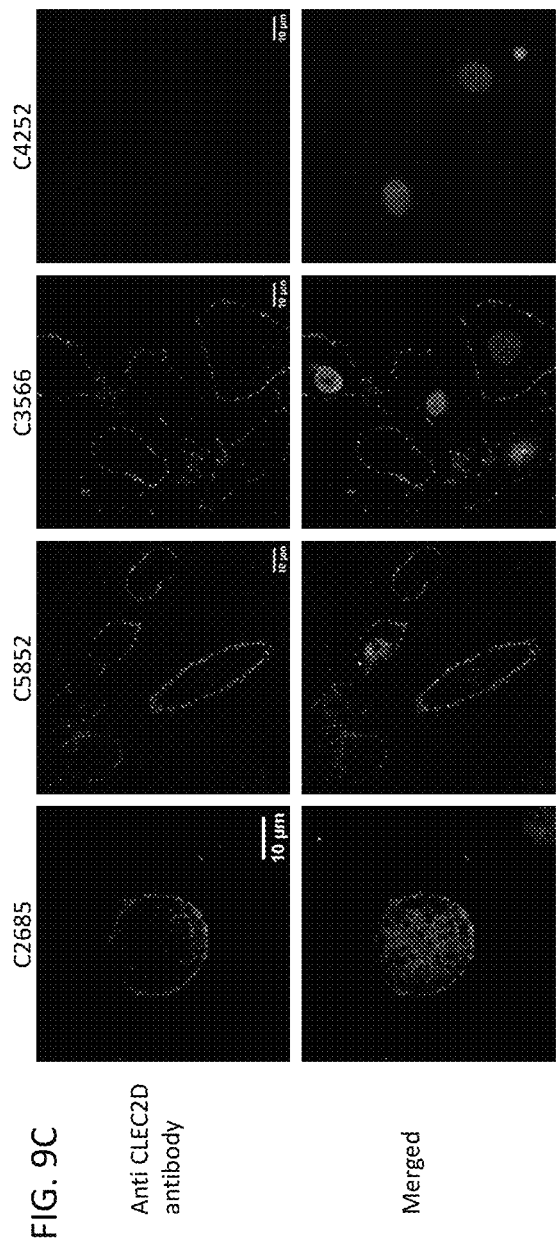

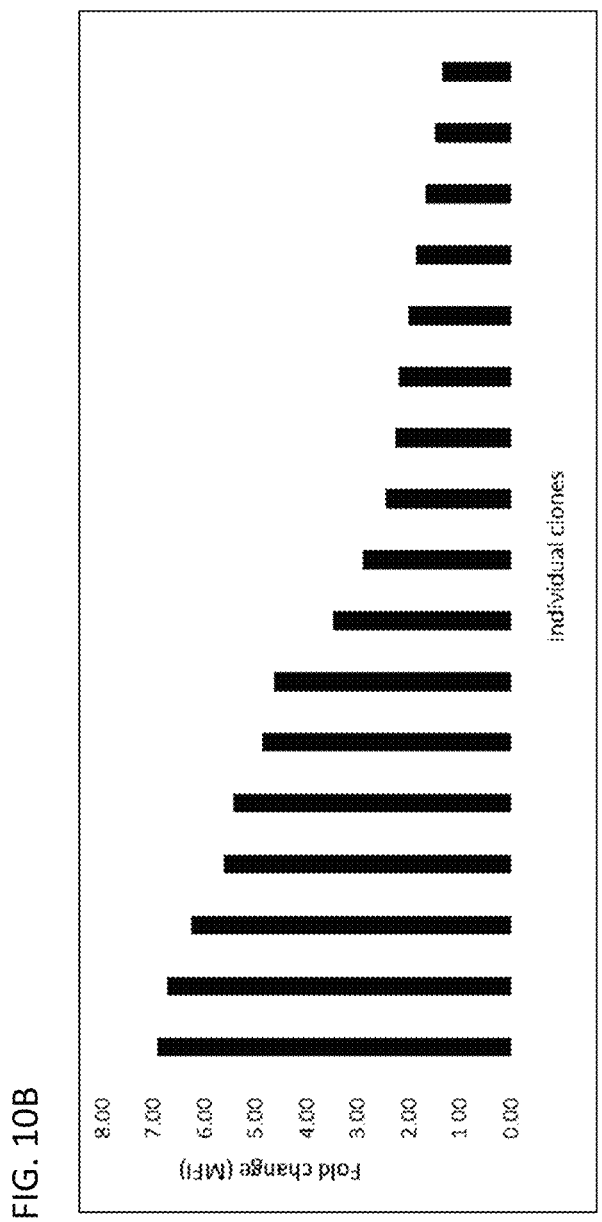

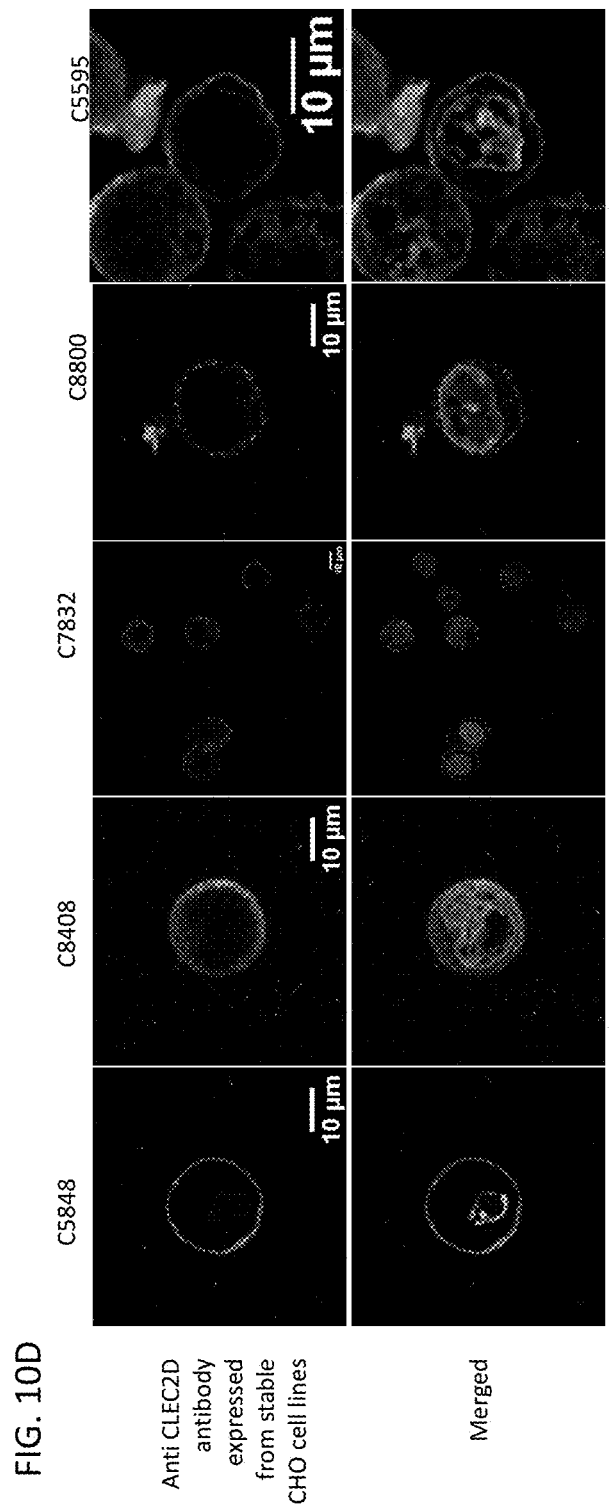

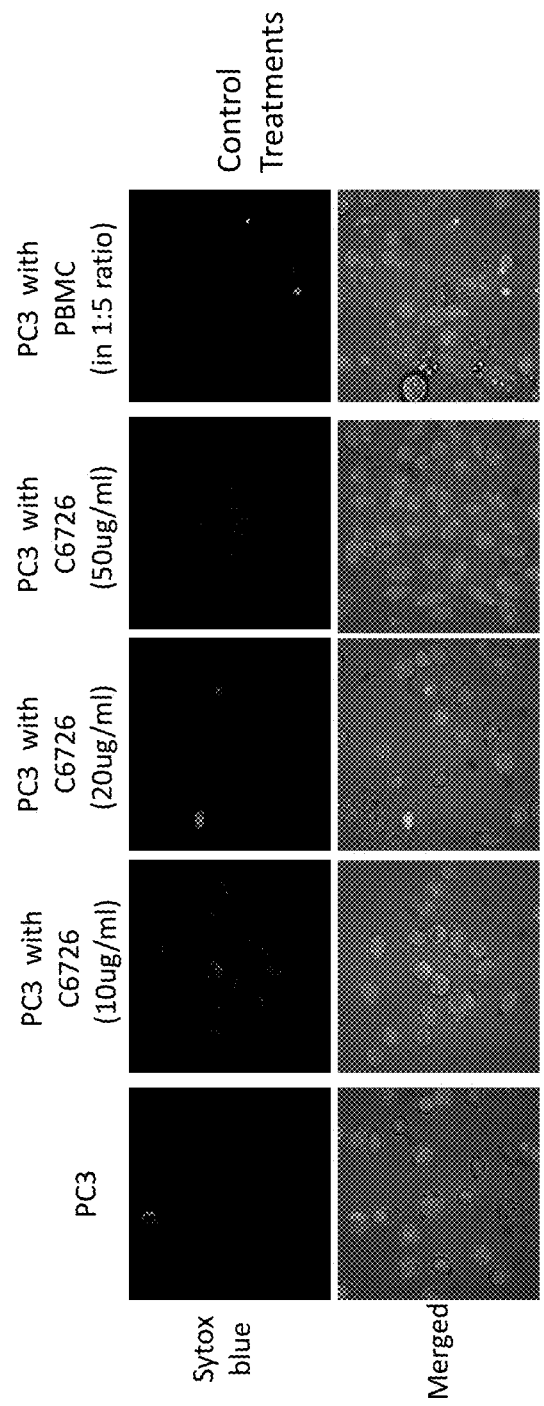

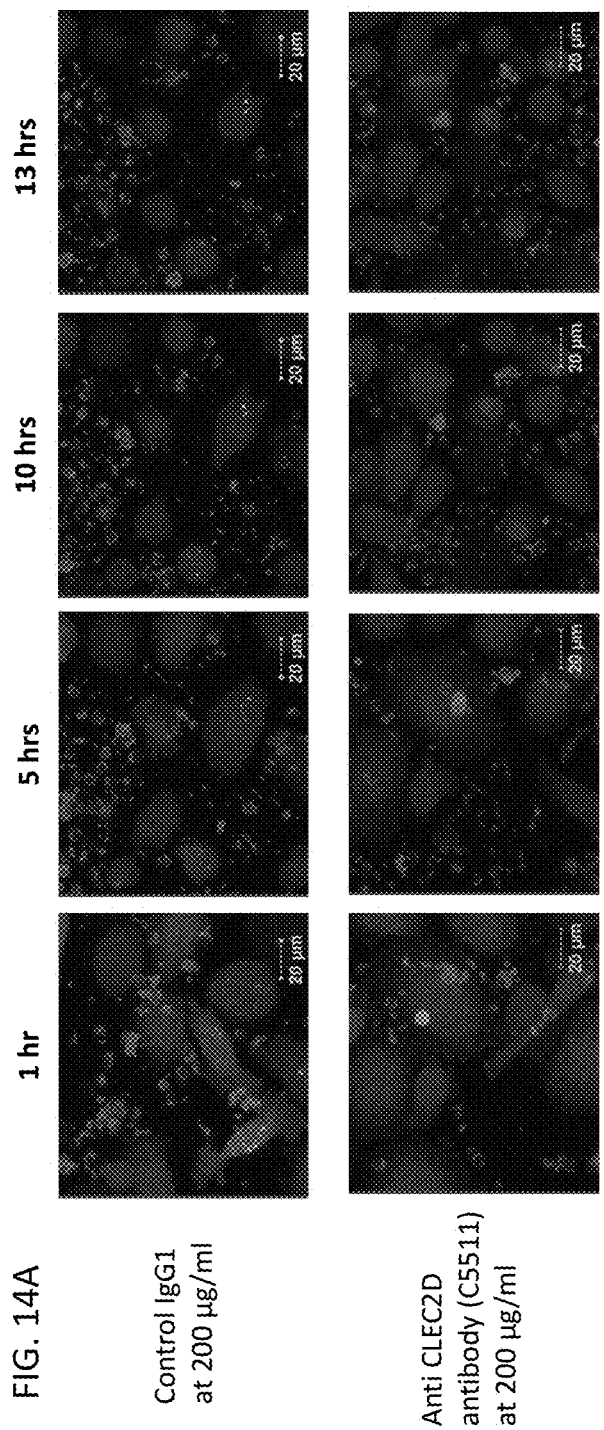

Anti CLEC2D antibody C4608 contact points on CLEC2D

Anti CLEC2D antibody C5511 contact points on CLEC2D

Anti CLEC2D antibody C4608 contacting CD161 overlapping binding sites on CLEC2D

Anti CLEC2D antibody C5511 contacting CD161 overlapping binding sites on CLEC2D

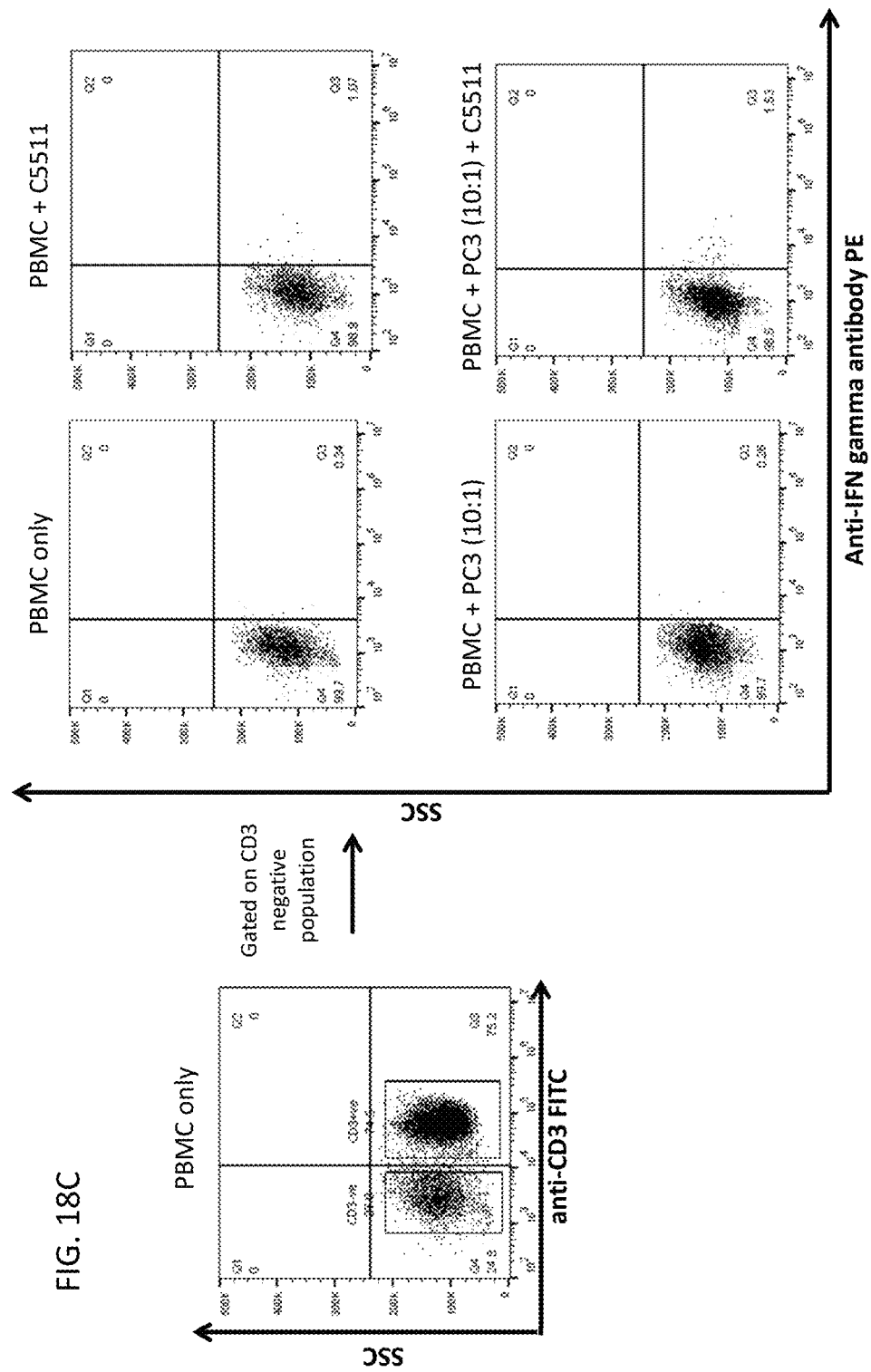

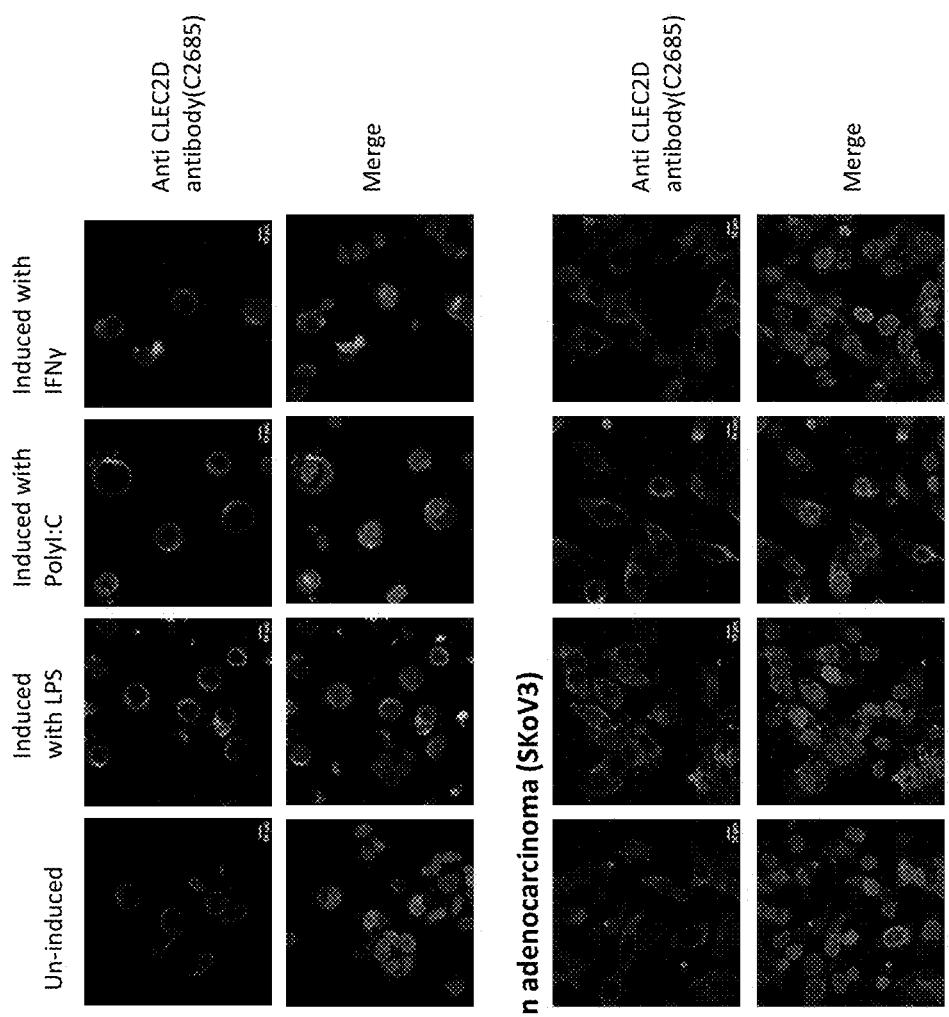

Glioma - LN229

Lymphoma - Ramos

ANTIBODIES THAT BIND TO C-TYPE LECTIN DOMAIN FAMILY 2 MEMBER D (CLEC2D)

RELATED APPLICATION

This application claims priority to and the benefit of Indian Provisional Patent Application No. 201941005395, filed on Feb. 11, 2019, the entire contents of which are incorporated herein by reference.

INCORPORATION-BY-REFERENCE OF SEQUENCE LISTING

The contents of the text file named ZMTR-001_001US Seq_List_ST25 which was created on Apr. 21, 2020, and is 3.518 megabytes in size, are incorporated herein by reference in their entirety.

TECHNICAL FIELD

The present disclosure relates to immunology, especially immune-oncology. Particularly, this disclosure relates to novel antibody molecules against CLEC2D antigen. This disclosure also relates to multiple formats and amino acid compositions of the disclosed antibody molecules, variable regions of the heavy and light chains of the antibody molecules, and CDR composition and length distribution against CLEC2D antigen. The compositions of this disclosure can be used either as monotherapies or in combination with other antibody molecules or any other therapeutic agents that are relevant for the treatment or prevention of diseases, such as cancer.

BACKGROUND

Modulation of immune cell checkpoint receptors via antibody-based/directed therapeutic approaches has been gaining constant interest over the last decade. Many of these receptors are involved in T cell checkpoint modulation. However, B cell, natural killer (NK) cell, and myeloid cell checkpoint modulation is attracting attention.

NK cells are part of the innate immunity which recognize and induce cytotoxicity against a wide range of target cells, such as tumor cells or virus infected cells. In addition, NK cells participate in the initiation and progress of the adaptive immune response through the production of various cytokines. Usually, these responses are regulated by the interaction of a wide array of activating and inhibitory receptors with ligands on the surface of the target cells and immune cells.

The NK cell receptors are divided into two main structural classes: the immunoglobulin and C-type lectin-like (CTL) superfamilies. The NKR-P1 receptors (e.g., CD161) are a family of C-type lectin-like transmembrane molecules that are important immuno-regulatory genes and are expressed on various cell types, including spleen dendritic cells, subsets of T cells and granulocytes. The Lectin-Like Transcript 1 (LLT1) or C-Type Lectin Domain Family 2 Member D (CLEC2D) or osteoclast inhibitory lectin (OCIL) molecule is a ligand for the CD161 receptor and this interaction differentially regulates the NK cell and T cell function. There are six splice variants of CLEC2D, isoform 1 being the canonical sequence which is expressed on NK cells, T cells, monocytes/macrophages, activated B cells and dendritic cells, and functions as a human NK cell activating receptor. The polypeptide chain of CLEC2D can be divided into the N-terminal cytoplasmic part, trans-membrane and stalk regions and C-terminal CTL ectodomain with two predicted N-glycosylation sites.

CLEC2D and CD161 interaction leads to escape from the host defense in several disease scenarios, including various cancers. Such immune escape has been reported in human glioblastoma and other diseases. Moreover, CLEC2D expression on B cells is thought to regulate cross-talk between NK cells and antigen presenting cells (APC). Blocking CLEC2D-CD161 interaction therefore provides a new therapeutic option for the treatment of various cancers.

The downstream signaling of CLEC2D-CD161 interactions is poorly understood. The interaction of CLEC2D/CD161 inhibits NK cell functions and stimulates T cell proliferation and secretion of cytokines. Hence, the effects of CLEC2D/CD161 interaction could be reversed by using monoclonal antibodies specifically binding to CLEC2D, and disrupting the interaction between CLEC2D and its known receptor CD161 or other unknown cellular mechanisms.

SUMMARY

The disclosure provides an isolated antibody or antigen-binding fragment thereof comprising a heavy chain and a light chain, wherein the heavy chain comprises a sequence selected from the group consisting of: (a) a sequence that is at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 46, SEQ ID NO: 65, SEQ ID NO: 59, and SEQ ID NO: 99; (b) a sequence that is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 57, SEQ ID NO: 91, SEQ ID NO: 98, SEQ ID NO: 84, SEQ ID NO: 58, SEQ ID NO: 88, SEQ ID NO: 96, SEQ ID NO: 47, SEQ ID NO: 17, and SEQ ID NO: 8; (c) a sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 93, SEQ ID NO: 53, SEQ ID NO: 95, SEQ ID NO: 23, SEQ ID NO: 103, and SEQ ID NO: 7; (d) a sequence that is at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 45, SEQ ID NO: 15, SEQ ID NO: 51, SEQ ID NO: 44, SEQ ID NO: 73, SEQ ID NO: 36, SEQ ID NO: 77, SEQ ID NO: 50, and SEQ ID NO: 6; (e) a sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5% or at least 99.9% identical or 100% identical to a sequence selected from SEQ ID NO: 97, SEQ ID NO: 16, SEQ ID NO: 76, SEQ ID NO: 9, SEQ ID NO: 89, SEQ ID NO: 107, SEQ ID NO: 68, SEQ ID NO: 29, SEQ ID NO: 67, SEQ ID NO: 74, SEQ ID NO: 32, SEQ ID NO: 81, SEQ ID NO: 106, SEQ ID NO: 31, SEQ ID NO: 62, SEQ ID NO: 48, SEQ ID NO: 75, SEQ ID NO: 12, SEQ ID NO: 102, SEQ ID NO: 54, SEQ ID NO: 80, SEQ ID NO: 26, SEQ ID NO: 30, SEQ ID NO: 92, SEQ ID NO: 108, and SEQ ID NO: 79; (f) a sequence that is at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5% or at least 99.9% identical or 100% identical to a sequence selected from SEQ ID NO: 105, SEQ ID NO: 101, SEQ ID NO: 4, SEQ ID NO: 72, SEQ ID NO: 28, SEQ ID NO: 64, SEQ ID NO: 25, SEQ ID NO: 60, SEQ ID NO: 55, SEQ ID NO: 52, SEQ ID NO: 27, SEQ ID NO: 43, SEQ ID NO: 70, SEQ ID NO: 71, SEQ ID NO: 14, SEQ ID NO: 85, SEQ ID NO: 13, SEQ ID NO: 61, SEQ ID NO: 42, SEQ ID NO: 39, SEQ ID NO: 10, SEQ ID NO: 49, SEQ ID NO: 24, SEQ ID NO: 40, SEQ ID NO: 63, SEQ ID NO: 78, SEQ ID NO: 2, SEQ ID NO: 94, and SEQ ID NO: 5; (g) a sequence that is at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5% or at least 99.9% identical or 100% identical to a sequence selected from SEQ ID NO: 11, SEQ ID NO: 35, SEQ ID NO: 86, SEQ ID NO: 22, SEQ ID NO: 69, SEQ ID NO: 41, SEQ ID NO: 3, SEQ ID NO: 66, SEQ ID NO: 37, SEQ ID NO: 56, SEQ ID NO: 21, SEQ ID NO: 38, SEQ ID NO: 90, SEQ ID NO: 100, SEQ ID NO: 18, SEQ ID NO: 20, SEQ ID NO: 83, SEQ ID NO: 1, and SEQ ID NO: 19; and (h) a sequence that is at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5% or at least 99.9% identical or 100% identical to a sequence selected from SEQ ID NO: 33, SEQ ID NO: 34, SEQ ID NO: 87, SEQ ID NO: 82, and SEQ ID NO: 104, wherein the antibody or antigen-binding fragment thereof binds to C-Type Lectin Domain Family 2 Member D (CLEC2D).

The disclosure provides isolated antibodies or antigen-binding fragments thereof comprising a heavy chain and a light chain, wherein the light chain comprises a sequence selected from the group consisting of: (a) sequence that is at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 218, SEQ ID NO: 249, SEQ ID NO: 230, SEQ ID NO: 279, SEQ ID NO: 316, SEQ ID NO: 237, SEQ ID NO: 322, SEQ ID NO: 225, SEQ ID NO: 318, SEQ ID NO: 233, SEQ ID NO: 305, SEQ ID NO: 280, SEQ ID NO: 283, SEQ ID NO: 242, SEQ ID NO: 286, SEQ ID NO: 297, SEQ ID NO: 309, and SEQ ID NO: 246; (b) a sequence that is at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 222, SEQ ID NO: 258, SEQ ID NO: 219, SEQ ID NO: 313, SEQ ID NO: 294, SEQ ID NO: 303, SEQ ID NO: 317, SEQ ID NO: 273, SEQ ID NO: 266, SEQ ID NO: 315, SEQ ID NO: 257, SEQ ID NO: 288, SEQ ID NO: 301, SEQ ID NO: 221, SEQ ID NO: 240, SEQ ID NO: 299, SEQ ID NO: 247, SEQ ID NO: 263, and SEQ ID NO: 274; (c) a sequence that is at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 231, SEQ ID NO: 250, SEQ ID NO: 260, SEQ ID NO: 226, SEQ ID NO: 271, SEQ ID NO: 256, SEQ ID NO: 272, SEQ ID NO: 278, SEQ ID NO: 302, SEQ ID NO: 320, SEQ ID NO: 295, SEQ ID NO: 292, SEQ ID NO: 229, SEQ ID NO: 264, SEQ ID NO: 252, SEQ ID NO: 267, SEQ ID NO: 304, SEQ ID NO: 300, SEQ ID NO: 311, and SEQ ID NO: 324; (d) a sequence that is at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 259, SEQ ID NO: 239, SEQ ID NO: 281, SEQ ID NO: 228, SEQ ID NO: 217, SEQ ID NO: 227, and SEQ ID NO: 251; (e) a sequence that is at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 307, SEQ ID NO: 262, SEQ ID NO: 253, SEQ ID NO: 276, SEQ ID NO: 323, SEQ ID NO: 234, SEQ ID NO: 261, SEQ ID NO: 312, and SEQ ID NO: 290; (f) a sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 254, SEQ ID NO: 289, SEQ ID NO: 238, SEQ ID NO: 268, SEQ ID NO: 248, SEQ ID NO: 284, SEQ ID NO: 244, SEQ ID NO: 310, SEQ ID NO: 243, SEQ ID NO: 285, SEQ ID NO: 220, SEQ ID NO: 255, SEQ ID NO: 293, SEQ ID NO: 298, SEQ ID NO: 235, SEQ ID NO: 319, SEQ ID NO: 245, SEQ ID NO: 224, SEQ ID NO: 291, SEQ ID NO: 277, and SEQ ID NO: 232; and (g) a sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 282, SEQ ID NO: 308, SEQ ID NO: 287, SEQ ID NO: 321, SEQ ID NO: 236, SEQ ID NO: 265, SEQ ID NO: 270, SEQ ID NO: 275, SEQ ID NO: 306, SEQ ID NO: 296, SEQ ID NO: 241, SEQ ID NO: 314, and SEQ ID NO: 223; wherein the antibody or antigen-binding fragment thereof binds to CLEC2D.

The disclosure provides isolated antibodies or antigen-binding fragments thereof, comprising: (a) a heavy chain comprising a sequence selected from: (i) a sequence that is at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 46, SEQ ID NO: 65, SEQ ID NO: 59, and SEQ ID NO: 99; (ii) a sequence that is at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 57, SEQ ID NO: 91, SEQ ID NO: 98, SEQ ID NO: 84, SEQ ID NO: 58, SEQ ID NO: 88, SEQ ID NO: 96, SEQ ID NO: 47, SEQ ID NO: 17, and SEQ ID NO: 8; (iii) a sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 93, SEQ ID NO: 53, SEQ ID NO: 95, SEQ ID NO: 23, SEQ ID NO: 103, and SEQ ID NO: 7; (iv) a sequence that is at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 45, SEQ ID NO: 15, SEQ ID NO: 51, SEQ ID NO: 44, SEQ ID NO: 73, SEQ ID NO: 36, SEQ ID NO: 77, SEQ ID NO: 50, and SEQ ID NO: 6; (v) a sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 97, SEQ ID NO: 16, SEQ ID NO: 76, SEQ ID NO: 9, SEQ ID NO: 89, SEQ ID NO: 107, SEQ ID NO: 68, SEQ ID NO: 29, SEQ ID NO: 67, SEQ ID NO: 74, SEQ ID NO: 32, SEQ ID NO: 81, SEQ ID NO: 106, SEQ ID NO: 31, SEQ ID NO: 62, SEQ ID NO: 48, SEQ ID NO: 75, SEQ ID NO: 12, SEQ ID NO: 102, SEQ ID NO: 54, SEQ ID NO: 80, SEQ ID NO: 26, SEQ ID NO: 30, SEQ ID NO: 92, SEQ ID NO: 108, and SEQ ID NO: 79; (vi) a sequence that is at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 105, SEQ ID NO: 101, SEQ ID NO: 4, SEQ ID NO: 72, SEQ ID NO: 28, SEQ ID NO: 64, SEQ ID NO: 25, SEQ ID NO: 60, SEQ ID NO: 55, SEQ ID NO: 52, SEQ ID NO: 27, SEQ ID NO: 43, SEQ ID NO: 70, SEQ ID NO: 71, SEQ ID NO: 14, SEQ ID NO: 85, SEQ ID NO: 13, SEQ ID NO: 61, SEQ ID NO: 42, SEQ ID NO: 39, SEQ ID NO: 10, SEQ ID NO: 49, SEQ ID NO: 24, SEQ ID NO: 40, SEQ ID NO: 63, SEQ ID NO: 78, SEQ ID NO: 2, SEQ ID NO: 94, and SEQ ID NO: 5; (vii) a sequence that is at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 11, SEQ ID NO: 35, SEQ ID NO: 86, SEQ ID NO: 22, SEQ ID NO: 69, SEQ ID NO: 41, SEQ ID NO: 3, SEQ ID NO: 66, SEQ ID NO: 37, SEQ ID NO: 56, SEQ ID NO: 21, SEQ ID NO: 38, SEQ ID NO: 90, SEQ ID NO: 100, SEQ ID NO: 18, SEQ ID NO: 20, SEQ ID NO: 83, SEQ ID NO: 1, and SEQ ID NO: 19; and (viii) a sequence that is at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 33, SEQ ID NO: 34, SEQ ID NO: 87, SEQ ID NO: 82, and SEQ ID NO: 104; and (b) a light chain comprising a sequence selected from: (i) a sequence that is at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 218, SEQ ID NO: 249, SEQ ID NO: 230, SEQ ID NO: 279, SEQ ID NO: 316, SEQ ID NO: 237, SEQ ID NO: 322, SEQ ID NO: 225, SEQ ID NO: 318, SEQ ID NO: 233, SEQ ID NO: 305, SEQ ID NO: 280, SEQ ID NO: 283, SEQ ID NO: 242, SEQ ID NO: 286, SEQ ID NO: 297, SEQ ID NO: 309, and SEQ ID NO: 246; (ii) a sequence that is at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 222, SEQ ID NO: 258, SEQ ID NO: 219, SEQ ID NO: 313, SEQ ID NO: 294, SEQ ID NO: 303, SEQ ID NO: 317, SEQ ID NO: 273, SEQ ID NO: 266, SEQ ID NO: 315, SEQ ID NO: 257, SEQ ID NO: 288, SEQ ID NO: 301, SEQ ID NO: 221, SEQ ID NO: 240, SEQ ID NO: 299, SEQ ID NO: 247, SEQ ID NO: 263, and SEQ ID NO: 274; (iii) a sequence that is at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 231, SEQ ID NO: 250, SEQ ID NO: 260, SEQ ID NO: 226, SEQ ID NO: 271, SEQ ID NO: 256, SEQ ID NO: 272, SEQ ID NO: 278, SEQ ID NO: 302, SEQ ID NO: 320, SEQ ID NO: 295, SEQ ID NO: 292, SEQ ID NO: 229, SEQ ID NO: 264, SEQ ID NO: 252, SEQ ID NO: 267, SEQ ID NO: 304, SEQ ID NO: 300, SEQ ID NO: 311, and SEQ ID NO: 324; (iv) a sequence that is at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 259, SEQ ID NO: 239, SEQ ID NO: 281, SEQ ID NO: 228, SEQ ID NO: 217, SEQ ID NO: 227, and SEQ ID NO: 251; (v) a sequence that is at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 307, SEQ ID NO: 262, SEQ ID NO: 253, SEQ ID NO: 276, SEQ ID NO: 323, SEQ ID NO: 234, SEQ ID NO: 261, SEQ ID NO: 312, and SEQ ID NO: 290; (vi.) a sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 254, SEQ ID NO: 289, SEQ ID NO: 238, SEQ ID NO: 268, SEQ ID NO: 248, SEQ ID NO: 284, SEQ ID NO: 244, SEQ ID NO: 310, SEQ ID NO: 243, SEQ ID NO: 285, SEQ ID NO: 220, SEQ ID NO: 255, SEQ ID NO: 293, SEQ ID NO: 298, SEQ ID NO: 235, SEQ ID NO: 319, SEQ ID NO: 245, SEQ ID NO: 224, SEQ ID NO: 291, SEQ ID NO: 277, and SEQ ID NO: 232; and (vii) a sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, at least 99.9% or 100% identical to a sequence selected from SEQ ID NO: 282, SEQ ID NO: 308, SEQ ID NO: 287, SEQ ID NO: 321, SEQ ID NO: 236, SEQ ID NO: 265, SEQ ID NO: 270, SEQ ID NO: 275, SEQ ID NO: 306, SEQ ID NO: 296, SEQ ID NO: 241, SEQ ID NO: 314, and SEQ ID NO: 223; wherein the antibody or antigen-binding fragment thereof binds to CLEC2D.

The disclosure provides isolated antibodies or antigen-binding fragments thereof comprising a heavy chain and a light chain, wherein the heavy chain comprises a sequence selected from any one of SEQ ID NOs: 1-108.

The disclosure provides isolated antibodies or antigen-binding fragments thereof comprising a heavy chain and a light chain, wherein the light chain comprises a sequence selected from any one of SEQ ID NOs: 217-324.

The disclosure provides isolated antibodies or antigen-binding fragments thereof comprising a heavy chain and a light chain, wherein the heavy chain comprises a sequence selected from any one of SEQ ID NOs: 1-108, and the light chain comprises a sequence selected from any one of SEQ ID NOs: 217-324.

The disclosure provides isolated antibodies or antigen-binding fragments thereof comprising a heavy chain and a light chain, wherein the heavy chain comprises: (i) a heavy chain (HC) CDR1 comprising a sequence selected from SEQ ID NOs: 433-485; (ii) an HC CDR2 comprising a sequence selected from SEQ ID NOs: 486-546; and (iii) an HC CDR3 comprising a sequence selected from SEQ ID NOs: 547-653, wherein the antibody or antigen-binding fragment thereof binds to CLEC2D.

The disclosure provides isolated antibodies or antigen-binding fragments thereof comprising a heavy chain and a light chain, wherein the light chain comprises: (i) a light chain (LC) CDR1 comprising a sequence selected from SEQ ID NOs: 654-726; (ii) an LC CDR2 comprising a sequence selected from SEQ ID NOs: 727-783; and (iii) an LC CDR3 comprising a sequence selected from SEQ ID NOs: 784-885; wherein the antibody or antigen-binding fragment thereof binds to CLEC2D.

The disclosure provides isolated antibodies or antigen-binding fragments thereof, comprising: a heavy chain comprising an HC CDR1 sequence selected from SEQ ID NOs: 433-485, an HC CDR2 sequence selected from SEQ ID NOs: 486-546, and an HC CDR3 sequence selected from SEQ ID NOs: 547-653; a light chain comprising a LC CDR1 sequence selected from SEQ ID NOs: 654-726, a LC CDR2 sequence selected from SEQ ID NOs: 727-783, and a LC CDR3 sequence selected from SEQ ID NOs: 784-885; or a combination thereof.

In some embodiments of the antibodies or antigen binding fragments thereof of the disclosure, the antibody or antigen-binding fragment thereof binds to: a human CLEC2D polypeptide comprising a sequence selected from SEQ ID NOs: 886-909; a human CLEC2D polypeptide comprising a sequence selected from SEQ ID NOs: 930-1003; a cynomolgus CLEC2D polypeptide comprising a sequence selected from SEQ ID NOs: 918-920; a mouse CLEC2D polypeptide comprising a sequence selected from SEQ ID NOs: 911-915; a rat CLEC2D polypeptide comprising a sequence of SEQ ID NO: 910; and/or a dog CLEC2D polypeptide comprising a sequence selected from SEQ ID NOs: 916-917.

The disclosure provides an isolated antibody or antigen-binding fragment thereof, comprising a heavy chain and a light chain, wherein the heavy chain comprises a heavy chain complementarity determining region (CDRH) 1, CDRH2 and CDRH3 amino acid sequence of an anti-CLEC2D antibody selected from the group consisting of: A1, B1, E1, P1, U1, Y1, E2, I2 and L2, as disclosed in Table 9A, and wherein the light chain comprises a light chain complementarity determining region (CDRL)1, CDRL2 and CDRL3 amino acid sequence of an anti-CLEC2D antibody selected from the group consisting of: A1, B1, E1, P1, U1, Y1, E2, I2 and L2, as disclosed in Table 9A.

The disclosure provides an isolated antibody or antigen-binding fragment thereof, comprising a heavy chain and a light chain, wherein the heavy chain comprises a variable heavy chain amino acid sequence of an anti-CLEC2D antibody selected from the group consisting of: A1, B1, E1, P1, U1, Y1, E2, I2 and L2, as disclosed in Table 9A, and wherein the light chain comprises a variable light chain amino acid sequence of an anti-CLEC2D antibody selected from the group consisting of: A1, B1, E1, P1, U1, Y1, E2, I2 and L2, as disclosed in Table 9A.

The disclosure provides an isolated antibody or antigen-binding fragment thereof, comprising a heavy chain and a light chain, wherein the heavy chain comprises a heavy chain frame work region sequence of a Germline family of an anti-CLEC2D antibody selected from the group consisting of: A1, B1, E1, P1, U1, Y1, E2, I2 and L2, of Table 9B, as disclosed herein, and wherein the light chain comprises a frame work region sequence of a light chain Germline family of an anti-CLEC2D antibody selected from the group consisting of: A1, B1, E1, P1, U1, Y1, E2, I2 and L2, of Table 9B, as disclosed herein.

In some embodiments of the antibodies or antigen binding fragments thereof of the disclosure, the antibody or antigen-binding fragment thereof is a monoclonal antibody.

In some embodiments of the antibodies or antigen binding fragments thereof of the disclosure, the antibody or antigen-binding fragment thereof blocks binding of CLEC2D to a receptor. In some embodiments, the receptor comprises a CD161 receptor, and the CD161 receptor comprises a sequence selected from SEQ ID NOs: 921-929.

In some embodiments of the antibodies or antigen binding fragments thereof of the disclosure, the antibody or antigen-binding fragment thereof is human, murine or chimeric. In some embodiments, the antigen-binding fragment is selected from the group consisting of Fv, Fav, F(ab')2, Fab', dsFv, scFv, sc(Fv)2, scFv-CH3, scFv-Fc, and diabody fragments. In some embodiments, the antibody or antigen-binding fragment thereof binds to human CLEC2D with an affinity (KD) of less than 100 nM.

The disclosure provides pharmaceutical compositions comprising peptides (e.g., antibodies or antigen-binding fragments thereof) or nucleic acids described in the disclosure.

The disclosure provides pharmaceutical compositions comprising antibodies or antigen-binding fragments thereof of the disclosure.

The disclosure provides pharmaceutical compositions comprising nucleic acids encoding the antibodies or antigen-binding fragments thereof of the disclosure.

In some embodiments of the pharmaceutical compositions of the disclosure, the pharmaceutical composition further comprises at least one of a buffer, a pharmaceutically acceptable diluent, a carrier, a solubilizer, an emulsifier, and a preservative.

The disclosure provides isolated nucleic acids comprising a polynucleotide sequence that encodes an amino acid heavy chain sequence selected from SEQ ID NOs: 109-216.

The disclosure provides isolated nucleic acids comprising a polynucleotide sequence that encodes an amino acid light chain sequence selected from SEQ ID NOs: 325-432.

The disclosure provides an isolated nucleic acid, comprising a polynucleotide sequence that encodes a heavy chain comprising a CDRH1, CDRH2 and CDRH3 amino acid sequence according to the CDRH1, CDRH2 and CDRH3 amino acid sequence respectively, of an anti-CLEC2D antibody selected from the group consisting of: A1, B1, E1, P1, U1, Y1, E2, I2 and L2, of Table 9A, as disclosed herein.

The disclosure provides an isolated nucleic acid, comprising a polynucleotide sequence that encodes a light chain comprising a CDRL1, CDRL2 and CDRL3 amino acid sequence according to the CDRL1, CDRL2 and CDRL3 amino acid sequence respectively, of an anti-CLEC2D antibody selected from the group consisting of: A1, B1, E1, P1, U1, Y1, E2, I2 and L2, of Table 9A, as disclosed herein.

The disclosure provides an isolated nucleic acid, comprising a polynucleotide sequence that encodes a heavy chain amino acid sequence according to variable heavy chain amino acid sequence of an anti-CLEC2D antibody antibody selected from the group consisting of: A1, B1, E1, P1, U1, Y1, E2, I2 and L2, of Table 9A, as disclosed herein.

The disclosure provides an isolated nucleic acid, comprising a polynucleotide sequence that encodes a light chain amino acid sequence according to variable light chain amino acid sequence of an anti-CLEC2D antibody selected from the group consisting of: A1, B1, E1, P1, U1, Y1, E2, I2 and L2, of Table 9A, as disclosed herein.

The disclosure provides an isolated nucleic acid, comprising a polynucleotide sequence that encodes a heavy chain comprising a framework region amino acid sequence according to heavy chain framework region amino acid sequence of an anti-CLEC2D antibody selected from the group consisting of: A1, B1, E1, P1, U1, Y1, E2, I2 and L2, of Table 9B, as disclosed herein.

The disclosure provides an isolated nucleic acid comprising a polynucleotide sequence that encodes a light chain comprising a framework region amino acid sequence according to light chain framework region amino acid sequence of an anti-CLEC2D antibody selected from the group consisting of: A1, B1, E1, P1, U1, Y1, E2, I2 and L2, of Table 9B, as disclosed herein.

The disclosure provides isolated nucleic acids comprising a polynucleotide sequence that encodes a heavy chain amino acid sequence of an antibody or antigen binding fragment thereof of the disclosure.

The disclosure provides isolated nucleic acids comprising a polynucleotide sequence that encodes a light chain amino acid sequence of an antibody or antigen binding fragment thereof of the disclosure.

The disclosure provides compositions comprising a first nucleic acid that encodes a polypeptide selected from SEQ ID NOs: 109-216 and a second nucleic acid that encodes a polypeptide selected from SEQ ID NOs: 325-432.

The disclosure provides vectors comprising the nucleic acids of the disclosure.

The disclosure provides cells comprising the nucleic acids, nucleic acid compositions or vectors of the disclosure. In some embodiments, the cell is a eukaryotic cell. In some embodiments, the eukaryotic cell is a mammalian cell. In some embodiments, the mammalian cell is selected from the group consisting of a CHO cell, a 293 cell, an NSO cell, a PER.C6 cell, and a B cell. In some embodiments, the mammalian cell is a 293-6E cell or a DG44 cell. In some embodiments, the cells express the antibodies or antigen binding fragments thereof of the disclosure. In some embodiments, the cell is a germline cell.

The disclosure provides cells producing the antibodies or antigen-binding fragments thereof of the disclosure The disclosure provides a method of treating a disease in a subject in need thereof, comprising administering to the subject a therapeutically effective amount of the antibodies or antigen-binding fragments thereof of the disclosure.

The disclosure provides a composition for use in treating a disease in a subject in need thereof, comprising a therapeutically effective amount of the antibodies or antigen-binding fragments thereof of the disclosure or the nucleic acids encoding the antibodies or antigen-binding fragments thereof of the disclosure.

The disclosure provides a composition for use in the manufacture of a medicament for the prevention or treatment of a disease in a subject in need thereof, comprising a therapeutically effective amount of the antibodies or antigen-binding fragments thereof of the disclosure or the nucleic acids encoding the antibodies or antigen-binding fragments thereof of the disclosure.

In some embodiments of the methods or compositions for use of the disclosure, the disease is rheumatoid arthritis. In some embodiments, the subject exhibits bone loss as a result of having rheumatoid arthritis. In some embodiments, administration of a therapeutically effective amount of the antibody or antigen-binding fragment thereof slows or reverses the bone loss in the subject.

In some embodiments of the methods or compositions for use of the disclosure, the disease is a cancer. In some embodiments, the cancer is selected from the group consisting of breast cancer, prostate cancer, endometrial cancer, uterine cancer, bladder cancer, kidney cancer, esophageal cancer, squamous cell carcinoma, uveal melanoma, glioma, glioblastoma, myeloma, pheochromocytoma, paraganglioma, follicular lymphoma, renal cell carcinoma, cendcal cancer, ovarian cancer, cervical cancer, lung cancer, colorectal cancer, brain cancer, pancreatic cancer, gastric cancer, intestinal cancer, testicular cancer, skin cancer, thyroid cancer, thymoma, head and neck cancer, liver cancer, pharynx cancer, adrenocortical cancer, cholangiocarcinoma, mesothelioma, sarcoma, leukemia, lymphoma, Hodgkin's disease, multiple myeloma, melanoma, astrocytoma, stomach cancer, and pulmonary adenocarcinoma. In some embodiments, a cell of the cancer expresses CLEC2D on the cell surface. In some embodiments, administration of a therapeutically effective amount of the antibodies or antigen-binding fragments thereof results in an anti-tumor response in the subject.

In some embodiments of the methods or compositions for use of the disclosure, the antibodies or antigen-binding fragments thereof are administered as a monotherapy. In some embodiments, the antibodies or antigen-binding fragments thereof are administered in combination with at least one of a T cell targeted immunomodulatory agent, a second immunomodulatory agent, a cancer vaccine, an adoptive cell therapy, an oncolytic virus, a second antibody therapy, a radiotherapy, an antibody drug conjugate, a small interfering RNA, a chemotherapy, an immunotherapy, an immune checkpoint inhibitor, a mitotic inhibitor, or a combination thereof. In some embodiments, the adoptive cell therapy comprises a CAR-T therapy. In some embodiments, administration of a therapeutically effective amount of the antibody or antigen-binding fragment thereof alleviates a sign or a symptom of the disease.

The disclosure provides an antibody library comprising at least about 108 unique monoclonal antibody clones, wherein at least about 80% of the antibody clones detectably and specifically bind a CLEC2D antigen.

In some embodiments of the antibody library of the disclosure, the CLEC2D antigen comprises an amino acid sequence selected from SEQ ID NOs: 886-920 and SEQ ID NOs: 930-1003. In some embodiments of the antibody library of the disclosure, the CLEC2D antigen comprises an amino acid sequence selected from SEQ ID NOs: 886-909 and SEQ ID NOs: 930-1003. In some embodiments, the CLEC2D antigen comprises a CLEC2D antigen expressed on a tumor cell surface, a variant of the CLEC2D antigen, or a homolog of the CLEC2D antigen. In some embodiments, the variant of the CLEC2D antigen comprises a fragment of the CLEC2D protein. In some embodiments, the homolog of the CLEC2D antigen comprises a human, a mouse, a dog, a rat or a cynomolgus CLEC2D.

The disclosure provides a method of modulating immunity in a subject in need thereof, comprising administering to the subject a therapeutically effective amount of the antibodies or antigen-binding fragments of the disclosure or the nucleic acids encoding the antibodies or antigen-binding fragments thereof of the disclosure.

The disclosure provides a method of modulating (e.g., increasing) innate immunity in a subject in need thereof, comprising administering to the subject a therapeutically effective amount of the antibodies or antigen-binding fragments of the disclosure or the nucleic acids encoding the antibodies or antigen-binding fragments thereof of the disclosure.

The disclosure provides a method of increasing the cytotoxicity of a natural killer cell in a subject in need thereof, comprising administering to the subject a therapeutically effective amount of the antibodies or antigen-binding fragments thereof of the disclosure or the nucleic acids encoding the antibodies or antigen-binding fragments thereof of the disclosure.

The disclosure provides a method of modulating (e.g., increasing) adaptive immunity in a subject in need thereof, comprising administering to the subject a therapeutically effective amount of the antibodies or antigen-binding fragments of the disclosure or the nucleic acids encoding the antibodies or antigen-binding fragments thereof of the disclosure.

The disclosure provides methods of screening a high diversity antibody gene library for antibodies that to a CLEC2D antibody comprising: (a) inserting a library of antibody genes into a phage protein gene and transforming a plurality of phages to produce a phage library, wherein the phages in the phage library display the library of antibody genes on the surface of the phage; (b) panning the phage library with a CLEC2D antigen for individual phages that bind to the CLEC2D antigen, thereby producing an enriched phage library that is enriched for antibody genes that encode antibodies that bind to the CLEC2D antigen; (c) repeating step (b) at least once or at least twice; (d) transferring the antibody genes from the enriched phage library to a yeast surface display library; (e) isolating individual yeast cells that bind to the CLEC2D antigen from the yeast surface display library; (f) culturing the isolated individual yeast cells that bind to the CLEC2D antigen to produce yeast surface display library clones; and (g) sequencing the yeast surface display library clones; thereby isolating antibody genes that bind to the CLEC2D antigen.

In some embodiments of the methods of screening of the disclosure, the panning step (b) comprises panning the phage library with CLEC2D coated magnetic beads. In some embodiments, the transferring step (d) comprises cloning the antibody genes into a yeast expression vector and transforming yeast cells. In some embodiments, the methods further comprise analyzing the surface expression of the antibody genes with a FLAG tag, a c-Myc tag, a polyhistidine tag or a V5 tag. In some embodiments, the testing step (e) comprises isolating yeast cells expressing antibody genes that bind to the CLEC2D antigen with flow cytometry. In some embodiments, the method further comprises repeating the flow cytometry isolation at least 1×, at least 2×, at least 3×, at least 4× or at least 5×. In some embodiments, the method further comprises cloning the antibody genes that bind to CLEC2D into a mammalian expression vector.

The disclosure provides methods of making a composition comprising anti-CLEC2D antibodies or antigen binding fragments thereof, comprising (a) transforming mammalian cells with a vector comprising a sequence encoding a promoter and a sequence encoding an anti-CLEC2D antibody or antibody fragment, wherein the sequence encoding the promoter and the anti-CLEC2D antibody or antibody fragment are operably linked; (b) culturing the mammalian cells under conditions suitable for the expression of the anti-CLEC2D antibody or antibody fragment; (c) centrifuging the cultured mammalian cells to produce a supernatant; (d) filtering the supernatant; and (e) purifying the filtered supernatant using liquid chromatography.

In some embodiments of the methods of the disclosure, the filtration step (d) comprises a 3 μm-30 μm filter. In some embodiments, the filtration step (d) further comprises a 0.22 μm filter. In some embodiments, the purifying step (e) comprises a Protein A column. In some embodiments, the protein A column is treated with a high salt wash buffer to remove host cell proteins. In some embodiments, the anti-CLEC2D antibody of fragment thereof is eluted using 30 mM Phosphate buffer at pH. 3.0-4.0. In some embodiments, the purifying step (e) further comprises an anion exchange chromatography (AEX) step. In some embodiments, the AEX step comprises a Q Sepharose column. In some embodiments, the Q Sepharose is pre-equilibrated in a pre-equilibration buffer comprising 10-100 mM Histidine. In some embodiments, the pre-equilibration buffer further comprises citrate, phosphate 2-(N-morpholino)ethanesulfonic acid (MES), acetate or a combination thereof. In some embodiments, the pre-equilibration buffer comprises a pH of 4.5-6.5. In some embodiments, the anti-CLEC2D antibody is eluted at step (e) with an elution buffer comprising 200-1000 mM NaCl, KCl or a combination thereof. In some embodiments, the elution buffer comprises a pH of 4.5-6.5.

In one aspect, this disclosure relates to the isolation of novel monoclonal antibodies that bind specifically to a CLEC2D antigen. The novel antibodies modulate (e.g., inhibit) the interaction of CD161 and CLEC2D to modify NK cell/immune cell mediated cytotoxicity and/or cytokine production.

In another aspect, this disclosure relates to cancer cells expressing CLEC2D are specifically recognized by these novel antibodies which may kill the tumor cells via ADCC (antibody dependent cellular cytotoxicity) and/or CDC (complement dependent cytotoxicity) and/or ADCP (antibody dependent cellular phagocytosis).

In a related aspect, this disclosure relates to methods of making an anti-CLEC2D antibody, comprising selecting from a high diversity antibody gene library an anti-CLEC2D antibody. In one embodiment, the high diversity antibody gene library is displayed through phage and/or yeast surface display. In one embodiment, the phage- and/or yeast-displayed high diversity antibody gene library is selected using purified CLEC2D antigen as a target. In one embodiment, the selected anti-CLEC2D antibody genes are expressed in a mammalian cell (e.g., Chinese hamster ovary (CHO) cell). In one embodiment, a single cell clone expressing an anti-CLEC2D antibody is expanded into a cell line and verified for anti-CLEC2D antibody expression. In one embodiment, overexpression of selected antibody clones is achieved through defined culture media, supplements, and specific bioreactor processes cumulatively described herein as upstream process development. In one embodiment, the anti-CLEC2D antibodies expressed from the cell line are purified to homogeneity, for example, through various filtration and chromatography, referred to herein as downstream purification processes.

The disclosure provides a method of treating a disease in a subject in need thereof, comprising: determining a level of CLEC2D protein in the subject; and administering a therapeutically effective amount of an anti-CLEC2D antibody to the subject.

In some embodiments of the methods of the disclosure, the disease is a cancer. In some embodiments, the cancer comprises breast cancer, prostate cancer, endometrial cancer, uterine cancer, bladder cancer, kidney cancer, esophageal cancer, squamous cell carcinoma, uveal melanoma, glioma, glioblastoma, myeloma, pheochromocytoma, paraganglioma, follicular lymphoma, renal cell carcinoma, cendcal cancer, ovarian cancer, cervical cancer, lung cancer, colorectal cancer, brain cancer, pancreatic cancer, gastric cancer, intestinal cancer, testicular cancer, skin cancer, thyroid cancer, thymoma, head and neck cancer, liver cancer, pharynx cancer, adrenocortical cancer, cholangiocarcinoma, mesothelioma, sarcoma, leukemia, lymphoma, Hodgkin's disease, multiple myeloma, melanoma, astrocytoma, stomach cancer, pulmonary adenocarcinoma, adenocarcinoma, acinic cell adenocarcinoma, adrenal cortical carcinomas, alveoli cell carcinoma, anaplastic carcinoma, basaloid carcinoma, basal cell carcinoma, bronchiolar carcinoma, bronchogenic carcinoma, renaladinol carcinoma, embryonal carcinoma, anometroid carcinoma, fibrolamolar liver cell carcinoma, follicular carcinomas, giant cell carcinomas, hepatocellular carcinoma, intraepidermal carcinoma, intraepithelial carcinoma, leptomanigio carcinoma, medullary carcinoma, melanotic carcinoma, menigual carcinoma, mesometonephric carcinoma, oat cell carcinoma, squamal cell carcinoma, sweat gland carcinoma, transitional cell carcinoma, tubular cell carcinoma, ameloblastic sarcoma, angiolithic sarcoma, botryoid sarcoma, endometrial stroma sarcoma, ewing sarcoma, fascicular sarcoma, giant cell sarcoma, granulositic sarcoma, immunoblastic sarcoma, juxaccordial osteogenic sarcoma, coppices sarcoma, leukocytic sarcoma (leukemia), lymphatic sarcoma (lympho sarcoma), medullary sarcoma, myeloid sarcoma (granulocitic sarcoma), austiogenci sarcoma, periosteal sarcoma, reticulum cell sarcoma (histiocytic lymphoma), round cell sarcoma, spindle cell sarcoma, synovial sarcoma, telangiectatic audiogenic sarcoma, Burkitt's lymphoma, NPDL, NML, NH, diffuse lymphomas, Hodgkin's lymphoma, non-Hodgkin's lymphoma, B-cell lymphoma, T-cell lymphoma, diffuse large B-cell lymphoma, acute myeloid lymphoma, chronic lymphocytic leukemia, chronic myeoloid leukemia, mantle cell lymphoma, and follicular lymphoma. In some embodiments, a cancer cell of the subject has an elevated level of CLEC2D protein when compared to a normal cell that does not have cancer. In some embodiments, an increased level of CLEC2D is associated with a poor prognostic outcome.

In some embodiments of the methods of the disclosure, the disease is an autoimmune or inflammatory disorder. In some embodiments, the autoimmune or inflammatory disorder is type I diabetes, rheumatoid arthritis, lupus, inflammatory bowel diseases, celiac disease, Crohn disease, ulcerative Colitis, psoriasis, or multiple Sclerosis.

In some embodiments of the methods of the disclosure, the disease is an autoimmune or inflammatory disorder. In some embodiments, the autoimmune disorder is type I diabetes, rheumatoid arthritis, lupus, inflammatory bowel diseases, celiac disease, Crohn disease, ulcerative Colitis, psoriasis, or multiple Sclerosis.

In some embodiments of the methods of the disclosure, the disease is infectious disease. In some embodiments, the disease is HIV infection, human Cytomegalovirus infection, Hepatitis B infection, Hepatitis C infection, Ebola virus infection, Dengue, Yellow fever, Listeriosis, Tuberculosis, Cholera, Malaria, Leishmaniasis, or Trypanosoma infection.

In another aspect, multiple in vitro and in vivo assays are used to characterize the novel antibodies produced from CHO cell lines which include, various biophysical parameters, antigen recognition, tumor cell surface binding, tumor cell death, production of cytokines, and analysis of downstream genes to define mode of action. These monoclonal antibodies are also tested for long term stability, various formulations relevant for therapeutic, prognostic and diagnostic uses in cancer, infectious diseases, autoimmune and chronic diseases. In another aspect, in vivo tumor suppression assays are carried out to establish anti-tumor activity of selected antibodies as monotherapy or in combination with other therapeutic products.

In one aspect, this disclosure further relates to the isolation of novel and unique monoclonal antibodies that bind specifically to CLEC2D antigen. In some aspect, the novel antibodies influence the interaction of CD161 and CLEC2D to modify immune cell (e.g., NK cell, B-cell, or T-cell) mediated cytotoxicity and/or cytokine production. In some aspects, various cancer cells, expressing CLEC2D, are recognized by these novel antibodies and have revealed cytotoxic effects through various means including, ADCC (antibody dependent cellular cytotoxicity) and/or CDC (Complement dependent cytotoxicity and/or ADCP (Antibody dependent cellular phagocytosis). In one aspect, the disclosure provides emphasis and postulates on the role of CLEC2D in cross-talk between lymphocytes and immune tolerance. In another aspect, in the realm of approved therapeutics or those in pre-clinical or clinical testing, the methods for identifying novel antibody molecules and related compositions provided herein comprise pharmaceutical features amenable to manufacturability/developability.

In one aspect, this disclosure relates to a method of treating a disease or disorder in a subject in need thereof, comprising administering to the subject a therapeutically effective amount of the antibody or antigen-binding fragment thereof of, wherein the antibody is an anti-CLEC2D antibody selected from the group consisting of: A1, B1, E1, P1, U1, Y1, E2, I2 and L2, of Table 9A and B, as disclosed herein.

In one aspect, this disclosure relates to a method of modulating immunity in a subject in need thereof, comprising administering to the subject a therapeutically effective amount of the antibody or antigen-binding fragment, wherein the antibody is an anti-CLEC2D antibody selected from the group consisting of: A1, B1, E1, P1, U1, Y1, E2, I2 and L2, of Table 9A and B, as disclosed herein.

In one aspect, this disclosure relates to a method of modulating (e.g., increasing) innate immunity in a subject in need thereof, comprising administering to the subject a therapeutically effective amount of the antibody or antigen-binding fragment, wherein the antibody is an anti-CLEC2D antibody selected from the group consisting of: A1, B1, E1, P1, U1, Y1, E2, I2 and L2, of Table 9A and B, as disclosed herein.

In one aspect, this disclosure relates to a method of modulating (e.g., increasing) adaptive immunity in a subject in need thereof, comprising administering to the subject a therapeutically effective amount of the antibody or antigen-binding fragment, wherein the antibody is an anti-CLEC2D antibody selected from the group consisting of: A1, B1, E1, P1, U1, Y1, E2, I2 and L2, of Table 9A and B, as disclosed herein.

In one aspect, this disclosure relates to a method of increasing the cytotoxicity of a natural killer cell in a subject in need thereof, comprising administering to the subject a therapeutically effective amount of the antibody or antigen-binding fragment, wherein the antibody is an anti-CLEC2D antibody selected from the group consisting of: A1, B1, E1, P1, U1, Y1, E2, I2 and L2, of Table 9A and B, as disclosed herein.

BRIEF DESCRIPTION OF THE FIGURES

The features of the present disclosure will become fully apparent from the following description taken in conjunction with the accompanying figures. The patent or application file contains at least one drawing executed in color. Copies of this patent or patent application publication with color drawings will be provided by the Office upon request and payment of the necessary fee. With the understanding that the figures depict only several embodiments in accordance with the disclosure and are not to be considered limiting its scope, the disclosure will be described further through use of the accompanying figures.

FIGS. 1A-1C illustrate present disclosure in a schematic format in: FIG. 1A, scenario wherein CLEC2D and CD161 interacts resulting in tumor cells escaping immune cells; FIG. 1B, scenario wherein interaction between CLEC2D and CD161 is blocked using an anti-CLEC2D antibody, resulting in lysis signal followed by killing of tumor cells; and FIG. 1C, scenario wherein ligation of CLEC2D antigen with anti-CLEC2D antibody resulting in activation of NK cell and in elevation of cytokine expression followed by enhanced target cell clearance either by direct killing or by involving other immune cells FIGS. 2 A-2F illustrate expression and purification of CLEC2D antigen in mammalian cell in.

FIGS. 4A-4E illustrate phage panning of antibody library with CLEC2D antigen coated on magnetic beads in: FIG. 4A, estimation of magnetic bead conjugation efficiency by flow cytometry; FIG. 4B, restriction enzyme digestion of independent heavy chain clones after panning of Fab library; FIG. 4C, restriction enzyme digestion of independent kappa light chain clones after panning of Fab library; FIG. 4D, restriction enzyme digestion of independent heavy chain clones after panning of ScFv library; and FIG. 4E, restriction enzyme digestion of independent kappa light chain clones after panning of ScFv library.

FIGS. 5A-5H illustrate screening of antibody against CLEC2D using yeast surface display in: FIG. 5A, plate images depicting yeast colony towards generation of ScFv antibody library through electroporation; FIG. 5B, plate images depicting generation of haploid heavy and light chain antibody libraries; FIG. 5C, plate images showing mating efficiency of haploid yeast strains containing heavy or light chain antibody libraries, wherein mating efficiency was estimated to be ~29%; FIG. 5D, representative flow cytometric analysis of binding of antibody molecules expressed on the yeast cell surface with CLEC2D antigen, the ScFv libraries were sorted multiple times to enrich high affinity yeast clones; FIG. 5E, representative flow cytometric analysis of binding of antibody molecules expressed on the yeast cell surface with CLEC2D antigen, the Fab libraries were sorted multiple times to enrich high affinity yeast clones; FIG. 5F, representative data on enrichment of yeast clones after multiple rounds of sorting, both in terms of expression and antigen recognition; FIG. 5G, the individual yeast clones were separated and tested with CLEC2D antigen to identify yeast cell lines expressing high affinity antibody clones; and FIG. 5H, representative flow cytometry data to show the percentage binding of a soluble CLEC2D antigen with monoclonal antibody clones. At least about 80% of the clones detectably and specifically bound to the CLEC2D antigen.

FIGS. 6A-6D illustrate the peer group sequence analysis of clones screened through yeast display platform in: FIG. 6A, bar graph showing the CDRH3 length distribution of selected molecules; FIG. 6B, bar graph displaying relative amino acid frequency distribution for heavy chain CDRH3 (Kabat nomenclature); FIG. 6C, pie chart exhibiting heavy chain consensus family distribution; and FIG. 6D, pie chart exhibiting light chain consensus family distribution.

FIGS. 7A-7B illustrate the mammalian expression constructs used to generate full-length monoclonal antibody in: FIG. 7A, the vector designed to clone selected antibody variable heavy chain genes after screening through phage and yeast display platforms; and FIG. 7B, the vector designed to clone selected antibody variable light chain (kappa) genes after screening through phage and yeast display platforms. Constructs were generated through gene synthesis followed by confirmation through restriction digestion and Sanger sequencing.

FIGS. 8A-8C illustrate mammalian expression system to express full-length CLEC2D on the cell surface, as shown in: FIG. 8A, CLEC2D gene expression construct was generated through gene synthesis followed by confirmation through restriction digestion and Sanger sequencing; and FIG. 8B, flow cytometry with commercially available anti-CLEC2D antibody (4C7) showing expression of CLEC2D on transfected CHO cell surface (C4548); and FIG. 8C, the surface expression of CLEC2D as monitored with anti-CLEC2D (4C7) antibody on fixed and non-permeabilized cells by confocal microscopy (60×). Binding of anti-CLEC2D antibody was observed on C4548 cells whereas no binding was observed in un-transfected CHO cells. The nucleus was counterstained with DAPI (blue). Scale bar is 10 μm.

FIGS. 9A-9C illustrate anti-CLEC2D monoclonal antibody clones purified from transiently transfected CHO cell. Antibody was purified using protein A column chromatography, as shown in: FIG. 9A, SDS-PAGE profile of representative Anti-CLEC2D antibodies. The purified antibodies were subjected to SDS-PAGE analysis in both non-reducing and reducing conditions. Anti-CLEC2D Antibody clone purified from C3566 was shown in lane 9, upper panel of reducing and non-reducing gels. All clones from lower panels, except clone in lane 4 revealed good profiles in reducing and non-reducing gels. Clones showing degraded products were not considered for further studies. Similar criteria was employed for other clones as described in example section; FIG. 9B, the interaction of purified anti-CLEC2D antibody with CLEC2D antigen expressed on CHO cell surface through flow cytometry; Representative antibody clones, as exemplified by, C4577, C2907, C3566, C5582, C5397, were evaluated for CLEC2D binding on CHO cell lines either untransfected or transfected with full length CLEC2D construct. Shift in MFI towards right indicated binding of respective clones towards surface expressed CLEC2D antigen; and FIG. 9C, representative images of interaction of anti-CLEC2D antibodies with CLEC2D antigen expressed on PC3 tumor cells. As shown in Table 22 a qualitative rating of binding was carried out, "+" indicating low binding to "+++" indicating very high binding. As exemplified, surface binding was not detected with antibody C4252, whereas with antibody C0610, low binding was observed thereby rated as (+) while other clones have showed differential yet significant surface binding. The nucleus was counterstained with DAPI (violet). Scale bar is 10 μm.

FIGS. 10A-10E illustrate stable CHO cell line development expressing Anti-CLEC2D antibody, as shown in: FIG. 10A, the binding studies carried out with surface expressed CLEC2D as monitored using supernatant obtained from CHO mini-pool samples transfected with Anti-CLEC2D antibody expression plasmid, using flow cytometry. Histogram represents extent of binding against surface CLEC2D antigen expressed on C4548 cell, as observed for various clones. Fold change in MFI has been plotted against individual mini-pools binding. Higher fold change indicating higher binding of anti-CLEC2D antibody to CLEC2D antigen; FIG. 10B, single cell clone screening—Anti CLED2D antibody expressed from single cell clonal lines was purified and used for flow cytometry experiments. Higher fold change in fluorescence signal indicates stronger binding of anti-CLEC2D antibody binding to CLEC2D antigen; FIG. 10C, flow cytometric analysis of monoclonal antibody producing stable CHO cell lines—anti-CLED2D antibody expressed from single cell clonal lines was purified and used for flow cytometry experiments. Multiple monoclonal cell lines expressing the Anti-CLEC2D antibodies were (such as C4608, C5093, C5511, C6481, C6726, C7720, C9103, C5848 and C3452) were tested for binding to CHO cell surface expressed CLEC2D antigen by flow cytometry. Fold increase in median fluorescence intensity was estimated and was observed to be in the range of 3-10 fold for multiple stable clones; FIG. 10D, representative images of interaction of anti-CLED2D monoclonal antibodies produced from clonal CHO cell lines with the CLEC2D antigen expressed on PC3 tumor cell line. As depicted herein, various anti-CLEC2D antibodies showed differential yet significant surface binding to CLEC2D antigen on PC3 cell surface. The nucleus was counterstained with DAPI (violet). Scale bar is 10 μm; and FIG. 10E, quantitative RT PCR performed on of anti-CLEC2D antibody-stable cell clones C4608 and C5511 to confirm stable integration of antibody heavy chain and light chain genes. GAPDH house-keeping gene was used as internal normalizer. The study was carried out for 60 generations of CHO monoclonal lines expressing the Anti-CLEC2D antibodies.

FIGS. 11A-11F illustrate functional characterization of monoclonal anti-CLEC2D antibodies, as shown in: FIG. 11A, the binding of anti-CLEC2D antibodies, C4608, C5511, C6481, C2438, C3452, C0949 on surface expressed CLEC2D on prostate cancer cell line, PC3. Shift in MFI towards right indicated binding of antibody to surface expressed CLEC2D antigen on PC3 cell line; and FIG. 11B, representative flow cytometric analysis of cytotoxicity assay performed on PC3 target cells using PBMC as effector cells, at a ratio of 1:5 at a fixed concentration of 100 ug/mL of Anti-CLEC2D antibodies. Clones assessed for functionality herein were C5511, C4608 and C6481 with PBMC from Donor 1, while antibodies purified from clones C5392 and C3452 were tested with PBMC from Donor 2. The percentage of PC3 live cells is indicated by APC (eFluor 670) positive cells and dead cells indicates Sytox green-positive cells. Respective single cell clones have been labelled against each plot; FIG. 11C, representative flow cytometry analysis of cytotoxicity assay performed on PC3 target cells using PBMC as effector cells (1:5), with increasing concentrations of anti-CLEC2D antibody (C5511) from 10 μg/mL to 200 ug/mL revealed increased dose dependent tumor cell cytotoxicity; FIG. 11D, representative flow cytometric analysis of cytotoxicity assay performed on PC3 target cells using PBMC as effector cells at fixed concentration of anti-CLEC2D antibody C5511. The tumor to effector cell ratio (T:E) was increased from 1:5 to 1:10. The data revealed with increasing proportion of effector cells leads to higher levels of tumor cell cytotoxicity; and FIG. 11E, end point cytotoxicity assay revealed significant cytotoxicity of tumor cells at 10 μg/mL. The assay also determines optimum concentration of anti-CLEC2D antibody to kill target cells using confocal microscopy. Upper panel indicates all control treatments where no cytotoxicity was observed as expected, and lower panel indicates the enhanced PC3 tumour cell death when treated with increasing the concentration of anti-CLEC2D antibody (C6726) in presence of PBMC (T:E=1:5). The maximum cell death were observed at concentration of 50 ug/ml of Anti-CLEC2D antibody. PC3 tumor cells—Green; PBMC—red; Dead cells—Blue; and FIG. 11F, end point cytotoxicity assay using selected anti-CLEC2D antibody to kill target cells using confocal microscopy. No cytotoxicity observed in control treatments like PC3 tumor cell alone, PBMC alone, PBMC with isotype human IgG1 antibody. PC3 tumor cell cytotoxicity was observed when Anti-CLEC2D antibody (C6726, C5848, C4608, C5511 and C6481) clones were used. Size enhanced images revealed PC3 tumor cells were surrounded by effector cells inducing tumor cell death. PC3 tumor cells—Green; PBMC—red; Dead cells—Blue.

FIGS. 12A-12D illustrate NK cell mediated cytotoxicity of tumor cells with anti-CLEC2D antibody, a shown in: FIG. 12A, cytotoxicity of PC3 tumor cells when treated with purified NK cells and anti-CLEC2D antibodies (C6481 & C5511) at 100 ug/ml. The data revealed 86% NK cell mediated cytotoxicity of PC3 tumor cells at T:E of 1:1. The percentage of PC3 dead cells indicates Sytox green-positive cells; FIG. 12B, no target cell death was observed when incubated with either isotype control (human IgG1 antibody) or with only NK cells increasing T:E ratio starting from 1:0.5 to 1:10; Scale bar is 10 μm and FIG. 12C, anti-CLEC2D antibody alone cannot induce cytotoxicity of PC3 tumor cell; Scale bar is 10 μm and FIG. 12D anti-CLEC2D antibody C5511 (at 50 ug/mL) revealed increasing PC3 tumor cell death with increasing T:E ratio starting from 1:0.5, 1:5 and 1:10 C5511. Scale bar is 10 μm.

FIGS. 14A-14B illustrate live cell imaging with Anti-CLEC2D antibody dependent cytotoxicity of PC3 tumor cells, a shown in: FIG. 14A, live cell imaging revealed cytotoxicity of PC3 tumor cells over a period of incubation with human PBMC cells and Anti-CLEC2D antibody at 200 µg/ml. The assay was carried out for 20 hrs in a humidifier maintained at 37° C. and 5% CO2 during the image acquisition. On the contrary, incubation with Control human IgG1 antibody (200 µg/ml) did not cause tumor cell cytotoxicity. Live PC3 tumor cells—Green; PBMC—Red; Dead cells—Blue; Scale bar is 20 µm and FIG. 14B, live cell imaging revealed cytotoxicity of PC3 tumor cells over a period of incubation with human NK cells and Anti-CLEC2D antibody at 200 µg/ml. The assay was carried out for 20 hrs in a humidifier maintained at 37° C. and 5% CO2 during the image acquisition. On the contrary, incubation with Control human IgG1 antibody (200 µg/ml) did not cause tumor cell cytotoxicity. Live PC3 tumor cells—Green; NK cells—Red; Dead cells—Blue. Scale bar is 20 µm.

FIGS. 15A-15G illustrate predictive models of anti-CLEC2D antibodies, as shown in: FIG. 15A, cartoon representation of epitope recognition (Chain A—Dark Blue, Chain B—Cyan) & CD161 (Chain C—Orange red, Chain D—Purple) complex PDB ID 5MGT; FIG. 15B, the red selections denote residues within 6 Å of NKR-P1's chains; FIG. 15C, ribbon representation of refined anti-CLEC2D antibody structures; respective clones for specific anti-CLEC2D monoclonal antibodies have been labelled appropriately. Variable light chain is depicted in darker shade while heavy chain variable region is shown in white; FIG. 15D, represents selected conformations following PIZSA scoring and conformation clustering principle, belonging to C4608, contributed to one of the clusters interacting against CLEC2D (darker shade); FIG. 15E, a visualization of the residues selected for mutation to determine if the G00001-G00004-G00007-G00010-G00015 cluster combination from C4608 contains the binding site towards CLEC2D antigen; FIG. 15F, represents selected conformations following PIZSA scoring and conformation clustering principle, belonging to C5511, contributed to one of the clusters interacting against CLEC2D (darker shade); and FIG. 15G, a visualization of the residues selected for mutation to determine if the G00001-G00005-G00011-G00019-G00020 cluster combination from C5511 contains the binding site towards CLEC2D antigen.

FIG. 16A, surface representation of anti-CLEC2D antibody C4608 contact points on CLEC2D antigen; FIG. 16B, anti-CLEC2D antibody C4608 contact points on CLEC2D antigen that are overlapping with CD161 binding regions on CLEC2D; FIG. 16C, surface representation of anti-CLEC2D antibody C5511 contact points on CLEC2D antigen; FIG. 16D, anti-CLEC2D antibody C5511 contact points with CLEC2D antigen that are overlapping with CD161 binding regions on CLEC2D; In all depictions darker shade indicates the interacting residue locations on CLEC2D antigen; FIG. 16E, anti-CLEC2D antibody mediated disruption of CLEC2D and CD161 interaction-monitoring of CLEC2D antigen bead conjugation efficiency check; FIG. 16F, binding of CD161-FC to CLEC2D antigen was observed on magnetic beads in concentration depend manner; FIG. 16G, flow cytometric monitoring of CD161 binding in the absence and presence of Anti-CLEC2D antibody as compared with control, as a measure of disruption of CD161 and CLEC2D binding, as indicated by the solid black arrow.

FIGS. 17A-17B illustrate NK cell activation with anti-CLEC2D antibody, as shown in: FIG. 17A, anti-CLE2D antibody C5511 induces CD69 expression indicating NK cell activation towards becoming cytotoxic. Respective experimental conditions have been mentioned against each plot. IL2 treatment was carried out as positive control of CD69 overexpression; and FIG. 17B, anti-CLEC2D antibody mediated CD69 expression is higher compared to PC3 cell primed CD69 expression level on NK cells.

FIGS. 18A-18D illustrate effects of anti-CLEC2D antibody C5511 on cytokine expression by effector cells, as shown in: FIG. 18A, anti-CLEC2D antibody C5511 was used at concentrations of 10 µg/mL and 100 µg/mL to monitor elevation in IFNγ expression level; FIG. 18B, anti-CLEC2D antibody C5511 was used at concentration of 100 ug/mL in the presence or absence of PC3 cells (E:T=10:1). IFNγ expression was monitored in the CD3+ve gated population; FIG. 18C, anti-CLEC2D antibody C5511 was used at concentration of 100 ug/mL in the presence or absence of PC3 cells (E:T=10:1). IFNγ expression was monitored in the CD3-ve gated population; and FIG. 18D, anti-CLEC2D antibody C5511 was used as at concentrations of 100 µg/mL in the presence or absence of isolated NK cell. IFNγ overexpression was observed with anti-CLEC2D antibody C5511.

FIGS. 19A-19G illustrate mammalian expression constructs used to generate full-length monoclonal antibody. Constructs were generated through gene synthesis followed by confirmation through restriction digestion and Sanger sequencing, as shown in: FIG. 19A, vector designed to clone selected antibody variable heavy chain genes in IgG4 backbone; FIG. 19B, vector designed to clone selected antibody variable heavy chain genes in IgG1 N to A backbone; FIG. 19C, flow cytometric analysis of binding of Anti-CLEC2D antibody with IgG4 isotype backbone (C3256 and C3276) to CLEC2D antigen expressed on surface of CHO cells. Binding was compared with un-transfected CHO cells, as estimated from peak shift towards right; FIG. 19D, cytotoxicity of Anti-CLEC2D antibody using various antibody isotypes. IgG1 isotype (C3452 & C4608) and IgG4 isotype (C3256 & C3276) Anti-CLEC2D antibodies exhibited significant cytotoxicity when incubated with freshly isolated PBMC and PC3 tumor cells; FIG. 19E, anti-CLEC2D antibody produced as afucosylated monoclonal antibodies C0613, C1301, C6268, C1699, C2437, C9832, C8900 and C7749 revealed binding to CHO cell surface expressed CLEC2D antigen by flow cytometry; FIG. 19F, NK cell-mediated cytotoxicity of PC3 tumor cells with the afucosylated anti-CLEC2D antibody (C7749, C8800,C9832) used at 5X lesser concentration than C5511. The data revealed afucosylated Anti-CLEC2D antibodies achieved nearly equal cell death at 5 times less concentration, indicating afucosylated Anti-CLEC2D antibodies are more cytotoxic; and FIG. 19G, CDC mediated cytotoxicity was measured for anti-CLEC2D antibody C5511 using Ramos and PC3 tumor cell lines. Rituximab was used as positive control.

FIGS. 20A-20K illustrate anti-tumor effects in cancer xenograft mouse model. HuNOG-EXL mice were used for PC3 xenograft and the tumor bearing animals were randomized and used for injecting Anti-CLEC2D antibody product, as shown in: FIG. 20A, tumor volume vs. time plot demonstrating significant anti tumor effects observed with Anti-CLEC2D antibody alone or in combination with anti-PDL1 antibody; FIG. 20B, images displaying immune cell infiltration through staining of CD3+ T cells in the tumor micro environment; FIG. 20C, images of mice with the xenograft showing Alexa 647 labelled anti-CLEC2D antibody injected into the tumor over a 96-hour period; FIG. 20D, effect of test compounds on tumor volume in humanized (huNOG-EXL) mice bearing subcutaneous PC-3 tumor xenografts (up to day 36). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version 8.3.0). $p<0.01$ statistically significant (Day 36) when C5511 mAb group was compared with Vehicle control IgG1 group; FIG. 20E, effect of test compounds on tumor volume in humanized (huNOG-EXL) mice bearing subcutaneous PC-3 tumor xenografts (up to day 24). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version 8.3.0). *$p<0.001$ and *$p<0.05$ statistically significant (Day 24) when C5511 mAb group and C6481 mAb group, respectively were compared to Vehicle control IgG1 group; FIG. 20F, effect of test compounds on delta tumor volume in humanized (huNOG-EXL) mice bearing subcutaneous PC-3 tumor xenografts (up to day 36). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version 8.3.0). $p<0.01$ statistically significant (Day 36) when C5511 mAb group was compared to Vehicle control IgG1 group; FIG. 20G, effect of test compounds on delta tumor volume in humanized (huNOG-EXL) mice bearing subcutaneous PC-3 tumor xenografts (up to day 24). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version.8.3.0). *$p<0.001$ and *$p<0.05$ statistically significant (Day 24) when C5511 mAb group and C6481 mAb group, respectively were compared to Vehicle control IgG1 group; FIG. 20H, effect of test compounds on relative tumor volume in humanized (huNOG-EXL) mice bearing subcutaneous PC-3 tumor xenografts (up to day 36). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version 8.3.0). *$p<0.05$ statistically significant (Day 36) when C5511 mAb group was compared to Vehicle control IgG1 group; FIG. 20I, effect of test compounds on relative tumor volume in humanized (huNOG-EXL) mice bearing subcutaneous PC-3 tumor xenografts (up to day 24). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version.8.3.0). ***$p<0.001$ and *$p<0.05$ statistically significant (Day 24) when C5511 mAb group and C6481 mAb group, respectively were compared to Vehicle control IgG1 group; FIG. 20J, effect of test compounds on delta relative tumor volume in humanized (huNOG-EXL) mice bearing subcutaneous PC-3 tumor xenografts (up to day 36). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version.8.3.0). *$p<0.05$; and statistically significant (Day 36) when C5511 mAb group was compared to Vehicle control IgG1 group; and FIG. 20K, effect of test compounds on delta relative tumor volume in humanized (huNOG-EXL) mice bearing subcutaneous PC-3 tumor xenografts (up to day 24). Each treatment group consisted of 5 animals and named as C5511 mAb group, Vehicle control IgG1 group and C6481 mAb group. Values are expressed as mean of 2-5 animals in each group. Statistical analysis was carried out by Two-way ANOVA followed by Bonferroni post-tests using Graph Pad Prism (Version.8.3.0). ***$p<0.001$ and *$p<0.05$ statistically significant (Day 24) when C5511 mAb group and C6481 mAb group, respectively were compared to Vehicle control IgG1 group.

FIGS. 21A-21I illustrate characterization of purified Anti-CLEC2D antibody product, as shown in: FIG. 21A, SDS-PAGE analysis of purified C5511 antibody in non reducing and reducing conditions; FIG. 21B, TIC chromatogram from Intact Mass spectrometry analysis of Anti-CLEC2D antibody (3 replicates); FIG. 21C, WCX chromatogram analysis of Anti-CLEC2D antibody; FIG. 21D, Size Exclusion chromatogram of Anti-CLEC2D antibody; FIG. 21E, ELISA assay development of Anti-CLEC2D antibody against CLEC2D purified biotinylated antigen. The data was fit to one site binding model to calculate Kd of Anti-CLEC2D antibody; FIGS. 21E and 21F, CLEC2D antigen affinity based binding studies of representative Anti-CLEC2D antibody. FIG. G, Purified CLEC2D antigen ecto-domain was used as source of antigen in BIACORE studies; Response monitored has been plotted against time; FIG. 21H, affinity based binding studies of representative Anti-CLEC2D antibody molecules with FcRn at pH 5.9; and FIG. 21I, affinity based binding studies of representative Anti-CLEC2D antibody molecules with FcRn at at pH 7.4.

FIGS. 22A-22C illustrate that anti-CLEC2D antibody for plausible diagnostic and prognostic applications, as shown in: FIG. 22A, selection of Anti-CLEC2D antibody (C0949) based on binding characteristics. Four Anti-CLEC2D antibodies were evaluated (C2779, C2438, C0949 and C2543) for CLEC2D binding on PC3 target cells. C0949 showed excellent binding and peak median shift; FIG. 22B, anti-CLEC2D antibody C0949 recognizes CLEC2D antigen on multiple prostate cancer cell lines; and FIG. 22C, anti-CLEC2D antibody C0949 recognizes CLEC2D antigen on multiple tumor cell lines. Specific binding and fold change in mean fluorescence was calculated by ratio of mean FITC fluorescence between test and control.

FIGS. 23A-23D illustrate that anti-CLEC2D antibody recognize CLEC2D antigen on prostate cancer tumor cells, as shown in: FIG. 23A, expression level of CLEC2D antigen on prostate cancer disease stage after TCGA data analysis; FIG. 23B, expression level of CLEC2D antigen on prostate cancer cell lines PC3, DU145, 22RV1 and LnCap; FIG. 23C, expression level of CLEC2D antigen on prostate cancer cell lines PC3, LnCap, 22RV1, and DU145 with induction using LPS, Poly I:C, IFN-γ, PBMC supernatant, PBMC cells, NK cells and T cells. Upper panel with anti-CLEC2D antibody, lower panel representing the merged image; and FIG. 23D, human tissue microarray slides stained with anti-CLEC2D antibody C2685 showing staining of tumor cells in malignant prostate cancer tissue.

FIGS. 24A-24D illustrate that anti-CLEC2D antibody recognize CLEC2D antigen on various other tumor cells, as shown in: FIG. 24A, TCGA data analysis for CLEC2D antigen expression in various cancers; FIG. 24B, expression level of CLEC2D antigen on various tumor cell lines HepG2 (liver cancer), LN229 (Glioblastoma), SKOV3 (Ovary cancer), BT474 (Breast cancer), NCI-H929 (Myeloma), and Ramos (Lymphoma); FIG. 24C, expression level of CLEC2D antigen on BT474 (Breast cancer), SKOV3 (Ovary cancer), LN229 (Glioblastoma), Ramos (Lymphoma), NCI-H929 (Myeloma) and HepG2 (liver cancer), upon induction with LPS, Poly I:C, IFNγ; FIG. 24D, anti-CLEC2D antibody C5511 mediated cytotoxicity observed on SKOV3 (ovary cancer) at 100 μg/ml; and anti-CLEC2D antibodies C5511 and C6481 mediated cytotoxicity observed on HepG2 (liver cancer) cell lines at 100 m/ml. The percentage of dead cells indicated by Sytox green-positive cells.

FIGS. 25A-25E illustrate lymphocyte proliferation assay with anti-CLEC2D antibody using flow cytometry analysis, as shown in: FIG. 25A, Antibody wet-coating protocol; FIG. 25B, Air dried antibody coating protocol; FIG. 25C, High density pre-culture protocol; FIG. 25D, measurement of IFNγ cytokine secretion from effector cells when PBMC are incubated with Anti-CLEC2D antibodies (C5511, C4608, C6481) for extended period. Treatment with OKT3 antibody was used as a positive control; and FIG. 25E, measurement of IL2 cytokine secretion from effector cells when PBMC are incubated with Anti-CLEC2D antibodies (C5511, C4608, C6481) for extended period. Treatment with OKT3 antibody was used as a positive control. PBMCs were treated with anti CD3 antibody OKT3 (1 μg/ml), Anti-CLEC2D antibody C4608, C5511 and C6481 (1 μg/ml, 10 μg/ml, 50 μg/ml & 100 μg/ml) and incubated for four days. The fluorescent proliferation dye status was monitored using flow cytometer. Untreated PBMC was used as a control.

DETAILED DESCRIPTION

Figure 1A:
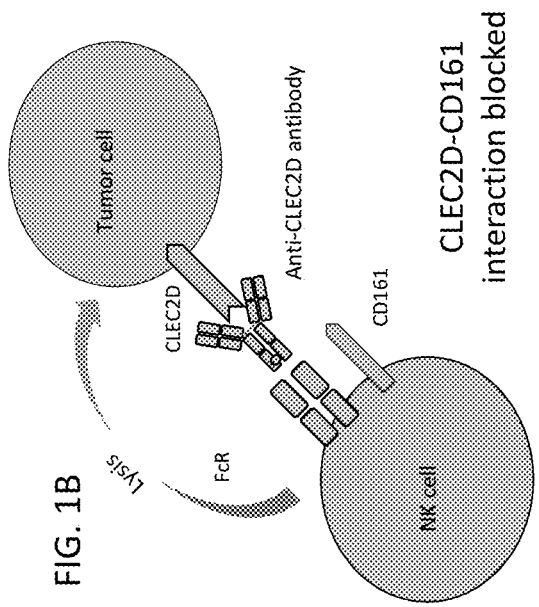

Modulation of immune cell checkpoint receptors via antibody-based/directed therapeutic approaches has been gaining constant interests over the past few years. The largest efforts have been centered on T cell checkpoint modulation. However, there is an increasing attention in B cell, NK cell, and myeloid cell checkpoint modulation as well. The innate immune system includes natural killer (NK) cells, which possess the ability to recognize and induce the cytotoxicity of a wide range of target cells, such as, tumor cells or virus infected cells. NK cells do not need any prior antigen sensitization. Apart from direct cytotoxicity, NK cells also participate in the initiation and progress of the adaptive immune response through the production and secretion of cytokines. Usually, these responses are regulated by adequate balance of signals induced by the interaction of a wide array of surface-activating and surface-inhibitory receptors with ligands on the surface of target cells. Modulation of NK cell numbers and/or its relevant function through a variety of agents such as monoclonal antibodies, cytokines may result in enhanced anti-tumor activity. These agents can be offered either alone or in combination as potential therapeutics. Therefore, anti-cancer activity of NK cell can be unleashed through harnessing surface receptors, both activating and/or inhibitory kinds.

Blocking these interactions may be a new therapeutic option for treatment of several cancers. However, the finding, understanding and designs need to be tuned and therapeutic treatment needs to be further tailored for specific receptor as targets against various cancers, which is still unmet.

Unless otherwise defined herein, scientific and technical terms used in connection with the present disclosure shall have the meanings that are commonly understood by those of ordinary skill in the art. Further, unless otherwise required by context, singular terms shall include the plural and plural terms shall include the singular as is considered appropriate to the context and/or application. The various singular/plural permutations may be expressly set forth herein for the sake of clarity. Generally, nomenclatures used in connection with, and techniques of biotechnology, immunology, molecular and cellular biology, recombinant DNA technology described herein are those well known and commonly used in the art. Certain references and other documents cited herein are expressly incorporated herein by reference. In case of conflict, the present specification, including definitions, will control. The materials, methods, figures and examples are illustrative only and not intended to be limiting.

Furthermore, the methods, preparation and use of the antibody naïve library disclosed employ, unless otherwise indicated, conventional techniques in molecular biology, biochemistry, computational chemistry, cell culture, recombinant DNA technology, Polymerase Chain Reaction (PCR) and related fields. These techniques, their principles, and requirements are explained in the literature and known to a person skilled in the art.

Before the method of generating the antibody naïve library and the nucleic acids which encode the antibody naïve library and other embodiments of the present disclosure are disclosed and described, it is to be understood that the terminologies used herein are for the purpose of describing particular embodiments only and are not intended to be limiting. It must be noted that, as used in the specification and the appended claims, the singular forms "a," "an" and "the" include plural referents unless the context clearly dictates otherwise.

In one embodiment, the terms "library" and "libraries" are used interchangeably within this disclosure, which relate to the product of the disclosure. In one embodiment, it refers to a collection or pool of nucleic acid sequences. In one embodiment, it refers to a collection or pool of amino acid sequences. In some embodiments, it refers to a collection or pool of organisms that comprise a collection or pool of amino acid sequences or nucleic acid sequences. In some embodiments, the organisms are bacteriophages (phages) or yeast (e.g., *Saccharomyces cerevisiae*).

In one embodiment, the terms 'pooling', 'pooled', 'pool', and 'pools' in the context of the instant disclosure means combining the samples/nucleic acid sequences/nucleic acid fragments/gene clones/amplified product/antibodies obtained by employing the method of the instant disclosure from multiple donors i.e., more than one donor.

In one embodiment, the term "PBMC" refers to any peripheral blood cell having a round nucleus consisting of lymphocytes (T cells, B cells, NK cells) and monocytes, erythrocytes, platelet, and granulocytes (neutrophils, basophils, and eosinophils).

Antigens

As used herein, the terms "antigen" or "immunogen" refer to any foreign substance which induces an immune response in the body. In one embodiment, an antigen is a cellular protein. In one embodiment, an antigen is a cell surface protein.

The antigen may be isolated or derived from any species. Representative species include, but are not limited to *Homo sapiens, Mus musculus, Rattus norvegicus, Canis lupis familiaris* and *Cynomolgus Macaca fascicularis*. In some embodiments, the antigen is a fragment of a wild type protein isolated or derived from *Homo sapiens, Mus musculus, Rattus norvegicus, Canis lupis familiaris* or *Cynomolgus Macaca fascicularis*. In some embodiments, the antigen is a mutant variant of a protein from *Homo sapiens, Mus musculus, Rattus norvegicus, Canis lupis familiaris* or *Cynomolgus Macaca fascicularis*. In some embodiments, antigens can be mutated to increase the solubility and/or stability of the antigen. For example, a CLEC2D antigens can include a mutation at H176C to introduce an additional disulphide bridge with the Cys163 amino acid to increase the stability and homogeneity of the expressed protein.

In some embodiments, the antigen includes an epitope tag at either the N or C terminus of the polypeptide. Exemplary tags include, but are not limited to polyHistidine tags and FLAG tags. Any epitope tag known in the art is envisaged as within the scope of the disclosure.

C-type lectin domain family 2 member D (CLEC2D), also referred to as CLAX, Lectin Like Transcript-1 (LLT1) and OCIL, is a member of the natural killer cell receptor C-type lectin family. CLEC2D binds to Killer Cell Lectin Like Receptor B1 (KLRB1). KLRB1 is also known as CD161, CLEC5B, NKR, NKR-P1, NKR-P1A, NKRP1A and hNKR-P1A. All orthologs and isoforms of CLEC2D and CD161 are considered to be within the scope of the present disclosure.

In some embodiments, a C-type lectin domain family 2 member D (CLEC2D) protein or any of its aliases or homologs, known in the art, whether from humans or other species, represents a target antigen of an antibody produced by the methods described herein.

In some embodiments, the antigen is a CLEC2D antigen that has at least 85%, at least 90%, at least 95%, at least 96%, at least 97% at least 98%, at least 99% or 100% identity to a CLEC2D sequence isolated or derived from *Homo sapiens, Mus musculus, Rattus norvegicus, Canis lupis familiaris* and *Cynomolgus Macaca fascicularis*.

In some embodiments, a CD161 protein or any of its aliases or homologs, known in the art, whether from humans or other species, represents a target antigen of an antibody produced by the methods described herein.

In some embodiments, the CD161 antigen has at least 85%, at least 90%, at least 95%, at least 96%, at least 97% at least 98%, at least 99% or 100% identity to a CD161 sequence isolated or derived from *Homo sapiens, Mus musculus, Rattus norvegicus, Canis lupis familiaris* and *Cynomolgus Macaca fascicularis*.

Exemplary antigens are shown in Table 1 below.

TABLE 1

Representative CLEC2D and CD161 Polypeptide Sequences

| SEQ ID | Description | Amino Acid Sequence |
| --- | --- | --- |
| SEQ ID 886 | Human (Homo sapiens) CLEC2D construct 1 | MHDSNNVEKDITPSELPANPGCLHSKEHSIKATLIWRLFFLIMFLTIIVCGMVAALSAIRANCHQ EPSVCLQAACPESWIGFQRKCFYFSDDTKNWTSSQRFCDSQDADLAQVESFQELNFLLRYKGP SDHWIGLSREQGQPWKWINGTEWTRQFPILGAGECAYLNDKGASSARHYTERKWICSKSDI HV |
| SEQ ID 887 | Human (Homo sapiens) CLEC2D construct 2 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDKGASSARHYTERKWICSKSDIHVHHH HHHHH |
| SEQ ID 888 | Human (Homo sapiens) CLEC2D construct 3 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDKGASSARCYTERKWICSKSDIHVHHH HHHHHG |
| SEQ ID 889 | Human (Homo sapiens) CLEC2D construct 4 | MSFVSLLLVGILFHATQAQAACPESWIGFQRKCFYFSDDTKNWTSSQRFCDSQDADLAQVES FQELNFLLRYKGPSDHWIGLSREQGQPWKWINGTEWTRQFPILGAGECAYLNDKGASSARH YTERKWICSKSDIHVHHHHHHHH |
| SEQ ID 890 | Human (Homo sapiens) CLEC2D construct 5 | MMSFVSLLLVGILFHATQAQAACPESWIGFQRKCFYFSDDTKNWTSSQRFCDSQDADLAQV ESFQELNFLLRYKGPSDHWIGLSREQGQPWKWINGTEWTRQFPILGAGECAYLNDKGASSAR CYTERKWICSKSDIHVHHHHHHHHG |
| SEQ ID 891 | Human (Homo sapiens) CLEC2D construct 6 | MMSFVSLLLVGILFHATQAHHHHHHHHDDDDKQAACPESWIGFQRKCFYFSDDTKNWTSS QRFCDSQDADLAQVESFQELNFLLRYKGPSDHWIGLSREQGQPWKWINGTEWTRQFPILGA GECAYLNDKGASSARCYTERKWICSKSDIHV |
| SEQ ID 892 | Human (Homo sapiens) CLEC2D construct 7 | HHHHHHHHDDDDKQAACPESWIGFQRKCFYFSDDTKNWTSSQRFCDSQDADLAQVESFQE LNFLLRYKGPSDHWIGLSREQGQPWKWINGTEWTRQFPILGAGECAYLNDKGASSARCYTER KWICSKSDIHV |
| SEQ ID 893 | Human (Homo sapiens) CLEC2D construct 8 | MMSFVSLLLVGILFHATQAQAACPESWIGFQRKCFYFSDDTKNWTSSQRFCDSQDADLAQV ESFQELNFLLRYKGPSDHWIGLSREQGQPWKWINGTEWTRQFPILGAGECAYLNDKGASSAA CAAAAAWICSKSDIHVHHHHHHHH |

TABLE 1-continued

Representative CLEC2D and CD161 Polypeptide Sequences

| SEQ ID | Description | Amino Acid Sequence |
|---|---|---|
| SEQ ID 894 | Human (Homo sapiens) CLEC2D construct 9 | MQLLRCFSIFSVIASVLAQAACPESWIGFQRKCFYFSDDTKNWTSSQRFCDSQDADLAQVESF QELNFLLRYKGPSDHWIGLSREQGQPWKWINGTEWTRQFPILGAGECAYLNDKGASSAACA AAAAWICSKSDIHVEFEQKLISEEDLDYKDDDDKENLYFQGLQASGGGGSGGGGSGGGGSQE LTTICEQIPSPTLESTPYSLSTTTILANGKAMQGVFEYYKSVTFVSNCGSHPSTTSKGSPINTQYV F |
| SEQ ID 895 | Human (Homo sapiens) CLEC2D construct 10 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDKGASSAACAAAAAWICSKSDIHVEFE QKLISEEDLDYKDDDDKENLYFQGLQASGGGGSGGGGSGGGGSQELTTICEQIPSPTLESTPYS LSTTTILANGKAMQGVFEYYKSVTFVSNCGSHPSTTSKGSPINTQYVF |
| SEQ ID 896 | Human (Homo sapiens) CLEC2D construct 11 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDKGASSAACAAAAAWICSKSDIHVHHH HHHHH |
| SEQ ID 897 | Human (Homo sapiens) CLEC2D construct 12 | MMSFVSLLLVGILFHATQAQAACPESWIGFQRKCFYFSDDTKNWTSSQRFCDSQDADLAQV ESFQELNFLLRYKGPSDHWIGLSREQGQPWKWINGTEWTRQFPILGAGECAALADKGASSAR CYTERKWICSKSDIHVHHHHHHHH |
| SEQ ID 898 | Human (Homo sapiens) CLEC2D construct 13 | QAACPESWIGFQRKCFYFSDDTKNWTSSQRFCDSQDADLAQVESFQELNFLLRYKGPSDHWI GLSREQGQPWKWINGTEWTRQFPILGAGECAALADKGASSARCYTERKWICSKSDIHVHHH HHHHH |
| SEQ ID 899 | Human (Homo sapiens) CLEC2D construct 14 | MQLLRCFSIFSVIASVLAQAACPESWIGFQRKCFYFSDDTKNWTSSQRFCDSQDADLAQVESF QELNFLLRYKGPSDHWIGLSREQGQPWKWINGTEWTRQFPILGAGECAALADKGASSARCY TERKWICSKSDIHVEFEQKLISEEDLDYKDDDDKENLYFQGLQASGGGGSGGGGSGGGGSQE LTTICEQIPSPTLESTPYSLSTTTILANGKAMQGVFEYYKSVTFVSNCGSHPSTTSKGSPINTQYV F |
| SEQ ID 900 | Human (Homo sapiens) CLEC2D construct 15 | QAACPESWIGFQRKCFYFSDDTKNWTSSQRFCDSQDADLAQVESFQELNFLLRYKGPSDHWI GLSREQGQPWKWINGTEWTRQFPILGAGECAALADKGASSARCYTERKWICSKSDIHVEFEQ KLISEEDLDYKDDDDKENLYFQGLQASGGGGSGGGGSGGGGSQELTTICEQIPSPTLESTPYSL STTTILANGKAMQGVFEYYKSVTFVSNCGSHPSTTSKGSPINTQYVF |
| SEQ ID 901 | Human (Homo sapiens) CLEC2D construct 16 | MMSFVSLLLVGILFHATQAQAACPESWIGFQRKCFYFSDDTKNWTSSQRFCDSQDADLAQV ESFQELNFLLRYKGPSDHWIGLSREQGQPWKWINGTEWTRQFPILGAGECAYLNDAGAASA RCYTERKWICSKSDIHVHHHHHHHH |
| SEQ ID 902 | Human (Homo sapiens) CLEC2D construct 17 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDAGAASARCYTERKWICSKSDIHVHHH HHHHH |
| SEQ ID 903 | Human (Homo sapiens) CLEC2D construct 18 | MQLLRCFSIFSVIASVLAQAACPESWIGFQRKCFYFSDDTKNWTSSQRFCDSQDADLAQVESF QELNFLLRYKGPSDHWIGLSREQGQPWKWINGTEWTRQFPILGAGECAYLNDAGAASARCY TERKWICSKSDIHVEFEQKLISEEDLDYKDDDDKENLYFQGLQASGGGGSGGGGSGGGGSQE LTTICEQIPSPTLESTPYSLSTTTILANGKAMQGVFEYYKSVTFVSNCGSHPSTTSKGSPINTQYV F |
| SEQ ID 904 | Human (Homo sapiens) CLEC2D construct 19 | QAACPESWIGFQRKCFYFSDDTKNWTSSQRFCDSQDADLAQVESFQELNFLLRYKGPSDHWI GLSREQGQPWKWINGTEWTRQFPILGAGECAYLNDAGAASARCYTERKWICSKSDIHVEFEQ KLISEEDLDYKDDDDKENLYFQGLQASGGGGSGGGGSGGGGSQELTTICEQIPSPTLESTPYSL STTTILANGKAMQGVFEYYKSVTFVSNCGSHPSTTSKGSPINTQYVF |
| SEQ ID 905 | Human (Homo sapiens) CLEC2D construct 20 | MHDSNNVEKDITPSELPANPGCLHSKEHSIKATLIWRLFFLIMFLTIIVCGMVAALSAIRANCHQ EPSVCLQAACPESWIGFQRKCFYFSDDTKNWTSSQRFCDSQDADLAQVESFQELNFLLRYKGP SDHWIGLSREQGQPWKWINGTEWTRQLVMKEDGANLYVAKVSQVPRMNPRPVMVSYPG SRRVCLFE |
| SEQ ID 906 | Human (Homo sapiens) CLEC2D construct 21 | MHDSNNVEKDITPSELPANPGCLHSKEHSIKATLIWRLFFLIMFLTIIVCGMVAALSAIRANCHQ EPSVCLQAACPESWIGFQRKCFYFSDDTKNWTSSQRFCDSQDADLAQVESFQELNFLLRYKGP SDHWIGLSREQGQPWKWINGTEWTRQ |
| SEQ ID 907 | Human (Homo sapiens) CLEC2D construct 22 | MHDSNNVEKDITPSELPANPGCLHSKEHSIKATLIWRLFFLIMFLTIIVCGMVAALSAIRANCHQ EPSVCLQAACPESWIGFQRKCFYFSDDTKNWTSSQRFCDSQDADLAQVESFQELVSYPGSRR VCLFE |

TABLE 1-continued

Representative CLEC2D and CD161 Polypeptide Sequences

| SEQ ID | Description | Amino Acid Sequence |
|---|---|---|
| SEQ ID 908 | Human (Homo sapiens) CLEC2D construct 23 | MHDSNNVEKDITPSELPANPAIRANCHQEPSVCLQAACPESWIGFQRKCFYFSDDTKNWTSS QRFCDSQDADLAQVESFQELNFLLRYKGPSDHWIGLSREQGQPWKWINGTEWTRQFPILGA GECAYLNDKGASSARHYTERKWICSKSDIHV |
| SEQ ID 909 | Human (Homo sapiens) CLEC2D construct 24 | MHDSNNVEKDITPSELPANPAIRANCHQEPSVCLQAACPESWIGFQRKCFYFSDDTKNWTSS QRFCDSQDADLAQVESFQELVSYPGSRRVCLFE |
| SEQ ID 910 | Rat (Rattus norvegicus) CLEC2D construct 1 | MPSSAHLQDPPPLLSRTLIQNEGQTSLRQSSSCGPSAASASESLSGSTESRIPHSKMLQGKLPR NIPLEYPAGLYCCYVVIIVLSVAVVALSVALSVKKTAQISTINTYAACPRNWIGVGNKCFYFNEIP SNWTLSQTLCKEQGAELARFDTEEELNFLRRYKGSSGYWFGLHRESSAHPWKWTDNTEYNN SVSIGGDEKHGFLSDNGFSSGRGYIVRKSICRKPNSYTSQCL |
| SEQ ID 911 | Mouse (Mus Musculus) CLEC2D construct 1 | MCVTKASLPMLSPTGSPQEVEVGKILQGKRHGTISPESCAKLYCYYGVIMVLTVAVIALSVALS ATKTEQIPVNKTYAACPQNWIGVENKCFYFSEYPSNWTFAQAFCMAQEAQLARFDNQDELN FLMRYKANFDSWIGLHRESSEHPWKWTDNTEYNNTIPIRGEERFAYLNNNGISSTRIYSLRM WICSKLNSYSLHCQTPFFPS |
| SEQ ID 912 | Mouse (Mus Musculus) CLEC2D construct 2 | MSFVSLLLVGILFHATQAYAACPQNWIGVENKCFYFSEYPSNWTFAQAFCMAQEAQLARFD NQDELNFLMRYKANFDSWIGLHRESSEHPWKWTDNTEYNNTIPIRGEERFAYLNNNGISSTRI YSLRMWICSKLNSYSLHCQTPFFPSHHHHHHHH |
| SEQ ID 913 | Mouse (Mus Musculus) CLEC2D construct 3 | YAACPQNWIGVENKCFYFSEYPSNWTFAQAFCMAQEAQLARFDNQDELNFLMRYKANFDS WIGLHRESSEHPWKWTDNTEYNNTIPIRGEERFAYLNNNGISSTRIYSLRMWICSKLNSYSLHC QTPFFPSHHHHHHHH |
| SEQ ID 914 | Mouse (Mus Musculus) CLEC2D construct 4 | MSFVSLLLVGILFHATQAYAACPQNWIGVENKCFYFSEYPSNWTFAQAFCMAQEAQLARFD NQDELNFLMRYKANFDSWIGLHRESSEHPWKWTDNTEYNNTIPIRGEERFAYLNNNGISSTR CYSLRMWICSKLNSYSLHCQTPFFPSHHHHHHHH |
| SEQ ID 915 | Mouse (Mus Musculus) CLEC2D construct 5 | YAACPQNWIGVENKCFYFSEYPSNWTFAQAFCMAQEAQLARFDNQDELNFLMRYKANFDS WIGLHRESSEHPWKWTDNTEYNNTIPIRGEERFAYLNNNGISSTRCYSLRMWICSKLNSYSLH CQTPFFPSHHHHHHHH |
| SEQ ID 916 | Dog (Canis lupus familiaris) CLEC2D construct 1 | MSFVSLLLVGILFHATQAEAACPESWIGFQRKCFYFSDDIKNWTFSQRFCDSYGADLVQIETLL ELNFLLRYKGPYDHWIGLSRDLGQPWKWVNGTEWTNCFPIRGGGECAYLNDKGASSARRYT ERKWICSKPDIYAQIKRQNSIHHHHHHHH |
| SEQ ID 917 | Dog (Canis lupus familiaris) CLEC2D construct 2 | EAACPESWIGFQRKCFYFSDDIKNWTFSQRFCDSYGADLVQIETLLELNFLLRYKGPYDHWIGL SRDLGQPWKWVNGTEWTNCFPIRGGGECAYLNDKGASSARRYTERKWICSKPDIYAQIKRQ NSIHHHHHHHH |
| SEQ ID 918 | Cynomolgus (Macaca fascicularis) CLEC2D construct 1 | MVTGSKMHDSNNVEKDIAPSELPANPGYRHSKQHSGKATLIWPLFFLIMFLTIIVCGMVVALS AIRANCHQKPSVCLQAACPESWIGFQRKCFYFSDDTKNWTSSQRFCDSQDAALAQVESFQEL NFLLRYKGPSDHWIGLSREQGQPWKWINGTEWTRQFPILGAGEYAYLNDKGASSARYYTERK WICSKPDTYVQMVQQSPN |
| SEQ ID 919 | Cynomolgus (Macaca fascicularis) CLEC2D construct 2 | MSFVSLLLVGILFHATQAQAACPESWIGFQRKCFYFSDDTKNWTSSQRFCDSQDAALAQVES FQELNFLLRYKGPSDHWIGLSREQGQPWKWINGTEWTRQFPILGAGEYAYLNDKGASSARYY TERKWICSKPDTYVQMVQQSPNHHHHHHHH |
| SEQ ID 920 | Cynomolgus (Macaca fascicularis) CLEC2D construct 3 | QAACPESWIGFQRKCFYFSDDTKNWTSSQRFCDSQDAALAQVESFQELNFLLRYKGPSDHWI GLSREQGQPWKWINGTEWTRQFPILGAGEYAYLNDKGASSARYYTERKWICSKPDTYVQMV QQSPNHHHHHHHH |
| SEQ ID 921 | Human (Homo sapiens) CD161 construct 1 | MDQQAIYAELNLPTDSGPESSSPSSLPRDVCQGSPWHQFALKLSCAGIILLVLVVTGLSVSVTSL IQKSSIEKCSVDIQQSRNKTTERPGLLNCPIYWQQLREKCLLFSHTVNPWNNSLADCSTKESSLL LIRDKDELIHTQNLIRDKAILFWIGLNFSLSEKNWKWINGSFLNSNDLEIRGDAKENSCISISQTS VYSEYCSTEIRWICQKELTPVRNKVYPDS |

TABLE 1-continued

Representative CLEC2D and CD161 Polypeptide Sequences

| SEQ ID | Description | Amino Acid Sequence |
|---|---|---|
| SEQ ID 922 | Human (Homo sapiens) CD161 construct 2 | MSFVSLLLVGILFHATQAQKSSIEKCSVDIQQSRNKTTERPGLLNCPIYWQQLREKCLLFSHTVN PWNNSLADCSTKESSLLLIRDKDELIHTQNLIRDKAILFWIGLNFSLSEKNWKWINGSFLNSNDL EIRGDAKENSCISISQTSVYSEYCSTEIRWICQKELTPVRNKVYPDSHHHHHHHH |
| SEQ ID 923 | Human (Homo sapiens) CD161 construct 3 | QKSSIEKCSVDIQQSRNKTTERPGLLNCPIYWQQLREKCLLFSHTVNPWNNSLADCSTKESSLLL IRDKDELIHTQNLIRDKAILFWIGLNFSLSEKNW KWINGSFLNSNDLEIRGDAKENSCISISQTSVYSEYCSTEIRWICQKELTPVRNKVYPDSHHHH HHH |
| SEQ ID 924 | Dog (Canis lupus familiaris) CD161 construct 1 | MSFVSLLLVGILFHATQAQNSSIEECRVDVQVNGNETTEKPNLLQCPVHWHLLQEKCLFFSHA SNTWKDSLTDCSAKESSLLLIQDQEELRLIRGLIYKKEILFWIGLNLTLSEKKWKWINGSFLNSNIL QIAGYNKESSCVYISLTGIVSENCDAENQWICQKELKPDRNKICSKFHHHHHHHH |
| SEQ ID 925 | Dog (Canis lupus familiaris) CD161 construct 2 | QNSSIEECRVDVQVNGNETTEKPNLLQCPVHWHLLQEKCLFFSHASNTWKDSLTDCSAKESSL LLIQDQEELRLIRGLIYKKEILFWIGLNLTLSEKKWKWINGSFLNSNILQIAGYNKESSCVYISLTGI VSENCDAENQWICQKELKPDRNKICSKFHHHHHHHH |
| SEQ ID 926 | Cynomolgus (Macaca fascicularis) CD161 construct 1 | MSFVSLLLVGILFHATQAQKPSIGKCSVDIQQNRTKTTERPDLLNCPIYWQQVQEKCLLFSHTV NPWNNSLADCSTKESSLLLIQDKDELTRTQNLIHDKAISFWIGLNFSLSEKNWKWINGSFLSSN DLKITGDAKENSCVYISQTSVYSEYCSTEMKWICQKELTLVRNKVSPDSWLHHHHHHHH |
| SEQ ID 927 | Cynomolgus (Macaca fascicularis) CD161 construct 2 | QKPSIGKCSVDIQQNRTKTTERPDLLNCPIYWQQVQEKCLLFSHTVNPWNNSLADCSTKESSL LLIQDKDELTRTQNLIHDKAISFWIGLNFSLSEKNWKWINGSFLSSNDLKITGDAKENSCVYISQ TSVYSEYCSTEMKWICQKELTLVRNKVSPDSWLHHHHHHHH |
| SEQ ID 928 | Mouse (Mus Musculus) CD161 construct 1 | MSFVSLLLVGILFHATQAQKPSREKCCVFIQENLNKTTDCSVNLECPQDWLLHRDKCFHVSQV SNTWEEGQADCGRKGATLLLIQDQEELRFLLDSIKEKYNSFWIGLRFTLPDMNWKWINGTTF NSDVLKITGVTENGSCASILGDKVTPESCASDNRWICQKELNHETPSNDSHHHHHHHH |
| SEQ ID 929 | Mouse (Mus Musculus) CD161 construct 2 | QKPSREKCCVFIQENLNKTTDCSVNLECPQDWLLHRDKCFHVSQVSNTWEEGQADCGRKGA TLLLIQDQEELRFLLDSIKEKYNSFWIGLRFTLPDMNWKWINGTTFNSDVLKITGVTENGSCASI LGDKVTPESCASDNRWICQKELNHETPSNDSHHHHHHHH |
| SEQ ID 930 | Human (Homo sapiens) CLEC2D construct 25 | MSFVSLLLVGILFHATQAQAACPESWIGFQRKCFYFSDDTKNWTSSQRFC DSQDADLAQVESFQELNFLLRYKGaSDHWIGLSREQGQPWKWI NGTEWTRQFPILGAGECAYLNDKGASSARCYTERKWICSKSDIH VHHHHHHH |
| SEQ ID 931 | Human (Homo sapiens) CLEC2D construct 26 | QAACPESWIGFQRKCFYFSDDTKNWTSSQRFCDSQDADLAQVE SFQELNFLLRYKGaSDHWIGLSREQGQPWKWINGTEWTRQFPIL GAGECAYLNDKGASSARCYTERKWICSKSDIHVHHHHHHH |
| SEQ ID 932 | Human (Homo sapiens) CLEC2D construct 27 | MSFVSLLLVGILFHATQAQAACPESWIGFQRKCFYFSDDTKNWTSSQRFC DSQDADLAQVESFQELNFLLRYKGPaDHWIGLSREQGQPWKWI NGTEWTRQFPILGAGECAYLNDKGASSARCYTERKWICSKSDIH VHHHHHHH |
| SEQ ID 933 | Human (Homo sapiens) CLEC2D construct 28 | QAACPESWIGFQRKCFYFSDDTKNWTSSQRFCDSQDADLAQVE SFQELNFLLRYKGPaDHWIGLSREQGQPWKWINGTEWTRQFPIL GAGECAYLNDKGASSARCYTERKWICSKSDIHVHHHHHHH |
| SEQ ID 934 | Human (Homo sapiens) CLEC2D construct 29 | MSFVSLLLVGILFHATQAQAACPESWIGFQRKCFYFSDDTKNWTSSQRFC DSQDADLAQVESFQELNFLLRYKGPSaHWIGLSREQGQPWKWI NGTEWTRQFPILGAGECAYLNDKGASSARCYTERKWICSKSDIH VHHHHHHH |
| SEQ ID 935 | Human (Homo sapiens) CLEC2D construct 30 | QAACPESWIGFQRKCFYFSDDTKNWTSSQRFCDSQDADLAQVE SFQELNFLLRYKGPSaHWIGLSREQGQPWKWINGTEWTRQFPIL GAGECAYLNDKGASSARCYTERKWICSKSDIHVHHHHHHH |

TABLE 1-continued

Representative CLEC2D and CD161 Polypeptide Sequences

| SEQ ID | Description | Amino Acid Sequence |
|---|---|---|
| SEQ ID 936 | Human (Homo sapiens) CLEC2D construct 31 | MSFVSLLLVGILFHATQAQAACPESWIGFQRKCFYFSDDTKNWTSSQRFC DSQDADLAQVESFQELNFLLRYKGPSDHWIGLSREaGQPWKWI NGTEWTRQFPILGAGECAYLNDKGASSARCYTERKWICSKSDIH VHHHHHHHH |
| SEQ ID 937 | Human (Homo sapiens) CLEC2D construct 32 | QAACPESWIGFQRKCFYFSDDTKNWTSSQRFCDSQDADLAQVE SFQELNFLLRYKGPSDHWIGLSREaGQPWKWINGTEWTRQFPIL GAGECAYLNDKGASSARCYTERKWICSKSDIHVHHHHHHHH |
| SEQ ID 938 | Human (Homo sapiens) CLEC2D construct 33 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGaCAYLNDKGASSARCYTERKWICSKSDIH VHHHHHHHH |
| SEQ ID 939 | Human (Homo sapiens) CLEC2D construct 34 | QAACPESWIGFQRKCFYFSDDTKNWTSSQRFCDSQDADLAQVE SFQELNFLLRYKGPSDHWIGLSREQGQPWKWINGTEWTRQFPIL GAGaCAYLNDKGASSARCYTERKWICSKSDIHVHHHHHHHH |
| SEQ ID 940 | Human (Homo sapiens) CLEC2D construct 35 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAaLNDKGASSARCYTERKWICSKSDIH VHHHHHHHH |
| SEQ ID 941 | Human (Homo sapiens) CLEC2D construct 36 | QAACPESWIGFQRKCFYFSDDTKNWTSSQRFCDSQDADLAQVE SFQELNFLLRYKGPSDHWIGLSREQGQPWKWINGTEWTRQFPIL GAGECAaLNDKGASSARCYTERKWICSKSDIHVHHHHHHHH |
| SEQ ID 942 | Human (Homo sapiens) CLEC2D construct 37 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDaGASSARCYTERKWICSKSDIHV HHHHHHHH |
| SEQ ID 943 | Human (Homo sapiens) CLEC2D construct 38 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDaGASSARCYTERKWICSKSDIHVHHHHHHHH |
| SEQ ID 944 | Human (Homo sapiens) CLEC2D construct 39 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASaARCYTERKWICSKSDIH VHHHHHHHH |
| SEQ ID 945 | Human (Homo sapiens) CLEC2D construct 40 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASaARCYTERKWICSKSDIHVHHHHHHHH |
| SEQ ID 946 | Human (Homo sapiens) CLEC2D construct 41 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSAaCYTERKWICSKSDIHV HHHHHHHH |
| SEQ ID 947 | Human (Homo sapiens) CLEC2D construct 42 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSAaCYTERKWICSKSDIHVHHHHHHHH |
| SEQ ID 948 | Human (Homo sapiens) CLEC2D construct 43 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCaTERKWICSKSDIH VHHHHHHHH |
| SEQ ID 949 | Human (Homo sapiens) CLEC2D construct 44 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCaTERKWICSKSDIHVHHHHHHHH |
| SEQ ID 950 | Human (Homo sapiens) CLEC2D construct 45 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCYaERKWICSKSDIH VHHHHHHHH |

TABLE 1-continued

Representative CLEC2D and CD161 Polypeptide Sequences

| SEQ ID | Description | Amino Acid Sequence |
|---|---|---|
| SEQ ID 951 | Human (Homo sapiens) CLEC2D construct 46 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYaERKWICSKSDIHVHHHHHHHH |
| SEQ ID 952 | Human (Homo sapiens) CLEC2D construct 47 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCYTaRKWICSKSDIH VHHHHHHHH |
| SEQ ID 953 | Human (Homo sapiens) CLEC2D construct 48 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYTaRKWICSKSDIHVHHHHHHHH |
| SEQ ID 954 | Human (Homo sapiens) CLEC2D construct 49 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCYTEaKWICSKSDIHV HHHHHHHH |
| SEQ ID 955 | Human (Homo sapiens) CLEC2D construct 50 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYTEaKWICSKSDIHVHHHHHHHH |
| SEQ ID 956 | Human (Homo sapiens) CLEC2D construct 51 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCYTERaWICSKSDIHV HHHHHHHH |
| SEQ ID 957 | Human (Homo sapiens) CLEC2D construct 52 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYTERaWICSKSDIHVHHHHHHHH |
| SEQ ID 958 | Human (Homo sapiens) CLEC2D construct 53 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAALADaGAaSARCYTERKWICSKSDIH VHHHHHHH |
| SEQ ID 959 | Human (Homo sapiens) CLEC2D construct 54 | QAACPESWIGFQRKCFYFSDDTKNWTSSQRFCDSQDADLAQVE SFQELNFLLRYKGPSDHWIGLSREQGQPWKWINGTEWTRQFPIL GAGECAALADaGAaSARCYTERKWICSKSDIHVHHHHHHH |
| SEQ ID 960 | Human (Homo sapiens) CLEC2D construct 55 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAaLaDAGAASARCYTERKWICSKSDIH VHHHHHHH |
| SEQ ID 961 | Human (Homo sapiens) CLEC2D construct 56 | QAACPESWIGFQRKCFYFSDDTKNWTSSQRFCDSQDADLAQVE SFQELNFLLRYKGPSDHWIGLSREQGQPWKWINGTEWTRQFPIL GAGECAaLaDAGAASARCYTERKWICSKSDIHVHHHHHHHH |
| SEQ ID 962 | Human (Homo sapiens) CLEC2D construct 57 | MSFVSLLLVGILFHATQAQAACPESWIGFQRKCFYFSDDTKNWTSSQaFC DSQDADLAQVESFQELNFLLRYKGPSDHWIGLSREQGQPWKWI NGTEWTRQFPILGAGECAYLNDKGASSARCYTERKWICSKSDIH VHHHHHHHH |
| SEQ ID 963 | Human (Homo sapiens) CLEC2D construct 58 | QAACPESWIGFQRKCFYFSDDTKNWTSSQaFCDSQDADLAQVES FQELNFLLRYKGPSDHWIGLSREQGQPWKWINGTEWTRQFPILG AGECAYLNDKGASSARCYTERKWICSKSDIHVHHHHHHHH |
| SEQ ID 964 | Human (Homo sapiens) CLEC2D construct 59 | MSFVSLLLVGILFHATQAQAACPESWIGFQRKCFYFSDDTKNWTSSQRFC DSQDADLAQVESFQELNFLLRYKGPSDHWIGLSREQGaPWKWI NGTEWTRQFPILGAGECAYLNDKGASSARCYTERKWICSKSDIH VHHHHHHHH |
| SEQ ID 965 | Human (Homo sapiens) CLEC2D construct 60 | QAACPESWIGFQRKCFYFSDDTKNWTSSQRFCDSQDADLAQVE SFQELNFLLRYKGPSDHWIGLSREQGaPWKWINGTEWTRQFPIL GAGECAYLNDKGASSARCYTERKWICSKSDIHVHHHHHHHH |

TABLE 1-continued

Representative CLEC2D and CD161 Polypeptide Sequences

| SEQ ID | Description | Amino Acid Sequence |
|---|---|---|
| SEQ ID 966 | Human (Homo sapiens) CLEC2D construct 61 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTaQFPILGAGECAYLNDKGASSARCYTERKWICSKSDIHV HHHHHHHH |
| SEQ ID 967 | Human (Homo sapiens) CLEC2D construct 62 | QAACPESWIGFQRKCFYFSDDTKNWTSSQRFCDSQDADLAQVE SFQELNFLLRYKGPSDHWIGLSREQGQPWKWINGTEWTaQFPIL GAGECAYLNDKGASSARCYTERKWICSKSDIHVHHHHHHHH |
| SEQ ID 968 | Human (Homo sapiens) CLEC2D construct 63 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSARCYTERKWICSKaDIH VHHHHHHHH |
| SEQ ID 969 | Human (Homo sapiens) CLEC2D construct 64 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYTERKWICSKaDIHVHHHHHHHH |
| SEQ ID 970 | Human (Homo sapiens) CLEC2D construct 65 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWIRQFPILGAGECAYLNDKGASSARCYTERKWICSKSDIaV HHHHHHHH |
| SEQ ID 971 | Human (Homo sapiens) CLEC2D construct 66 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSARCYTERKWICSKSDIaVHHHHHHHH |
| SEQ ID 972 | Human (Homo sapiens) CLEC2D construct 67 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSAaCaTaRKWICSKSDIHV HHHHHHHH |
| SEQ ID 973 | Human (Homo sapiens) CLEC2D construct 68 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSAaCaTaRKWICSKSDIHVHHHHHHHH |
| SEQ ID 974 | Human (Homo sapiens) CLEC2D construct 69 | MSFVSLLLVGILFHATQAQAACPESWIGFQaKCFYFSDDTKNWTSSQRFC DSQDADLAQVESFQELNFLLRYKGPSDHWIGLSREQGQPWKWI NGTEWIRQFPILGAGECAYLNDKGASSARCYTERKWICSKSDIaV HHHHHHHH |
| SEQ ID 975 | Human (Homo sapiens) CLEC2D construct 70 | QAACPESWIGFQaKCFYFSDDTKNWTSSQRFCDSQDADLAQVES FQELNFLLRYKGPSDHWIGLSREQGQPWKWINGTEWTRQFPILG AGECAYLNDKGASSARCYTERKWICSKSDIaVHHHHHHHH |
| SEQ ID 976 | Human (Homo sapiens) CLEC2D construct 71 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTaWaaaFPILGAGECAYLNDKGASSARCYTERKWICSKSDIHV HHHHHHHH |
| SEQ ID 977 | Human (Homo sapiens) CLEC2D construct 72 | QAACPESWIGFQRKCFYFSDDTKNWTSSQRFCDSQDADLAQVE SFQELNFLLRYKGPSDHWIGLSREQGQPWKWINGTaWaaaFPIL GAGECAYLNDKGASSARCYTERKWICSKSDIHVHHHHHHHH |
| SEQ ID 978 | Human (Homo sapiens) CLEC2D construct 73 | MSFVSLLLVGILFHATQAQAACPESWIGFQRKCFYFSDDTKNWTSSQaFC DaQDADLAQVESFQELNFLLRYKGPSDHWIGLSREQGQPWKWI NGTEWTRQFPILGAGECAYLNDKGASSARCYTERKWICSKSDIH VHHHHHHHH |
| SEQ ID 979 | Human (Homo sapiens) CLEC2D construct 74 | QAACPESWIGFQRKCFYFSDDTKNWTSSQaFCDaQDADLAQVES FQELNFLLRYKGPSDHWIGLSREQGQPWKWINGTEWTRQFPILG AGECAYLNDKGASSARCYTERKWICSKSDIHVHHHHHHHH |
| SEQ ID 980 | Human (Homo sapiens) CLEC2D construct 75 | MSFVSLLLVGILFHATQAQAACPESWIGFQRKCFYFSDDTKNWTSSQRFC DSQaADLAQVESFQELNFLLRYKGPSDHWIGLSREQGQPWKWI NGTEWIRQFPILGAGECAYLNDKGASSARCYTERKWICSKSDIaV HHHHHHHH |

TABLE 1-continued

Representative CLEC2D and CD161 Polypeptide Sequences

| SEQ ID | Description | Amino Acid Sequence |
| --- | --- | --- |
| SEQ ID 981 | Human (*Homo sapiens*) CLEC2D construct 76 | QAACPESWIGFQRKCFYFSDDTKNWTSSQRFCDSQaADLAQVES FQELNFLLRYKGPSDHWIGLSREQGQPWKWINGTEWTRQFPILG AGECAYLNDKGASSARCYTERKWICSKSDIaVHHHHHHHH |
| SEQ ID 982 | Human (*Homo sapiens*) CLEC2D construct 77 | MSFVSLLLVGILFHATQAQAACPESWIGFQRKCFYFSDDTKNWTSSQRFC DSQDADLAQVESFQELNFLLRYKGPSDHWIGLSREQGaPWKWI NGTEWTaQFPILGAGECAYLNDKGASSARCYTERKWICSKSDIHV HHHHHHHH |
| SEQ ID 983 | Human (*Homo sapiens*) CLEC2D construct 78 | QAACPESWIGFQRKCFYFSDDTKNWTSSQRFCDSQDADLAQVE SFQELNFLLRYKGPSDHWIGLSREQGaPWKWINGTEWTaQFPIL GAGECAYLNDKGASSARCYTERKWICSKSDIHVHHHHHHHH |
| SEQ ID 984 | Human (*Homo sapiens*) CLEC2D construct 79 | MSFVSLLLVGILFHATQAQAACPESWIGFQRKCFYFSDaaaNWTSSQRFC DSQDADLAQVESFQELNFLLRYKGPSDHWIGLSREQGQPWKWI NGTEWTRQFPILGAGECAYLNDKGASSARCYTERKWICSKSDIH VHHHHHHHH |
| SEQ ID 985 | Human (*Homo sapiens*) CLEC2D construct 80 | QAACPESWIGFQRKCFYFSDaaaNWTSSQRFCDSQDADLAQVES FQELNFLLRYKGPSDHWIGLSREQGQPWKWINGTEWTRQFPILG AGECAYLNDKGASSARCYTERKWICSKSDIHVHHHHHHHH |
| SEQ ID 986 | Human (*Homo sapiens*) CLEC2D construct 81 | MSFVSLLLVGILFHATQAQAACPESWIGFQRKCFYFSDDTKNWTSSQRFC DSQDADLAQVESFQELNFLLRYKGPSDHWIGLSREQGaPWaWIN GTEWTRQFPILGAGECAYLNDKGASSARCYTERKWICSKSDIHV HHHHHHHH |
| SEQ ID 987 | Human (*Homo sapiens*) CLEC2D construct 82 | QAACPESWIGFQRKCFYFSDDTKNWTSSQRFCDSQDADLAQVE SFQELNFLLRYKGPSDHWIGLSREQGaPWaWINGTEWTRQFPIL GAGECAYLNDKGASSARCYTERKWICSKSDIHVHHHHHHHH |
| SEQ ID 988 | Human (*Homo sapiens*) CLEC2D construct 83 | MSFVSLLLVGILFHATQAQAACPESWIGFQRKCFYFSDDTKNWTSSQRFC DSQDADLAQVESFQELNFLLRYKGPSDHWIGLSRaQGQPWKWI NGTEWTRQFPILGAGECAYLNDKGASSARaYTERKWICSKSDIHV HHHHHHHH |
| SEQ ID 989 | Human (*Homo sapiens*) CLEC2D construct 84 | QAACPESWIGFQRKCFYFSDDTKNWTSSQRFCDSQDADLAQVE SFQELNFLLRYKGPSDHWIGLSRaQGQPWKWINGTEWTRQFPIL GAGECAYLNDKGASSARaYTERKWICSKSDIHVHHHHHHHH |
| SEQ ID 990 | Human (*Homo sapiens*) CLEC2D construct 85 | MSFVSLLLVGILFHATQAQAACPESWIGFQRKCFYFSDDTKNWTSSQRFC DSQDADLAQVESFQELNFLLRYKGPSDHWIGLSRaaGaPWKWIN GTEWTRQFPILGAGECAYLNDKGASSAaCYTERKWICSKSDIHV HHHHHHH |
| SEQ ID 991 | Human (*Homo sapiens*) CLEC2D construct 86 | QAACPESWIGFQRKCFYFSDDTKNWTSSQRFCDSQDADLAQVE SFQELNFLLRYKGPSDHWIGLSRaaGaPWKWINGTEWTRQFPIL GAGECAYLNDKGASSAaCYTERKWICSKSDIHVHHHHHHHH |
| SEQ ID 992 | Human (*Homo sapiens*) CLEC2D construct 87 | MSFVSLLLVGILFHATQAQAACPESWIGFQRKCFYFSDaTKNWTSSQRFC DSQDADLAQVESFQELNFLLRYKGPSDHWIGLSREQGQPWKWI NGTEWTRQFPILGAGECAYLNDKGASSARCaTERaWICSKSDIHV HHHHHHHH |
| SEQ ID 993 | Human (*Homo sapiens*) CLEC2D construct 88 | QAACPESWIGFQRKCFYFSDaTKNWTSSQRFCDSQDADLAQVES FQELNFLLRYKGPSDHWIGLSREQGQPWKWINGTEWTRQFPILG AGECAYLNDKGASSARCaTERaWICSKSDIHVHHHHHHHH |
| SEQ ID 994 | Human (*Homo sapiens*) CLEC2D construct 89 | MSFVSLLLVGILFHATQAQAACPESWIGFQRKCFYFSDDTKNWTSSQRFC DSQDADLAQVESaQELNFLLRYKGPSDHWIGLSREQGQPWKWI NGTEWTaQFPILGAGECAYLNDKGASSARCYTERKWICSKSDIHV HHHHHHHH |
| SEQ ID 995 | Human (*Homo sapiens*) CLEC2D construct 90 | QAACPESWIGFQRKCFYFSDDTKNWTSSQRFCDSQDADLAQVE SaQELNFLLRYKGPSDHWIGLSREQGQPWKWINGTEWTaQFPIL GAGECAYLNDKGASSARCYTERKWICSKSDIHVHHHHHHHH |

TABLE 1-continued

Representative CLEC2D and CD161 Polypeptide Sequences

| SEQ ID | Description | Amino Acid Sequence |
|---|---|---|
| SEQ ID 996 | Human (Homo sapiens) CLEC2D construct 91 | MSFVSLLLVGILFHATQAQAACPESWIGFQRKCFYFSDDaKaWTSSQRFC DSQDADLAQVESFQELNFLLRYKGPSDHWIGLSREQGQPWKWI NGTEWTRQFPILGAGECAYLNDKGASSARCYTERKWICSKSDIH VHHHHHHHH |
| SEQ ID 997 | Human (Homo sapiens) CLEC2D construct 92 | QAACPESWIGFQRKCFYFSDDaKaWTSSQRFCDSQDADLAQVES FQELNFLLRYKGPSDHWIGLSREQGQPWKWINGTEWTRQFPILG AGECAYLNDKGASSARCYTERKWICSKSDIHVHHHHHHHH |
| SEQ ID 998 | Human (Homo sapiens) CLEC2D construct 93 | MSFVSLLLVGILFHATQAQAACPESWIGFQRKCFYFSDDaKNWTSSQRFC DSQDADLAQVESFQELNFLLRYKGPSDHWIGLSREQGQPWKWI NGTEWTRQFPILGAGECAYLNDKGASSARCaTaRKWICSKSDIH VHHHHHHHH |
| SEQ ID 999 | Human (Homo sapiens) CLEC2D construct 94 | QAACPESWIGFQRKCFYFSDDaKNWTSSQRFCDSQDADLAQVE SFQELNFLLRYKGPSDHWIGLSREQGQPWKWINGTEWTRQFPIL GAGECAYLNDKGASSARCaTaRKWICSKSDIHVHHHHHHHH |
| SEQ ID 1000 | Human (Homo sapiens) CLEC2D construct 95 | MSFVSLLLVGILFHATQAQAACPESWIGFQRKCFYFSDDTaNWTSSQaFC DSQDADLAQVESFQELNFLLRYKGPSDHWIGLSREQGQPWKWI NGTEWTRQFPILGAGECAYLNDKGASSARCYTaRKWICSKSDIH VHHHHHHHH |
| SEQ ID 1001 | Human (Homo sapiens) CLEC2D construct 96 | QAACPESWIGFQRKCFYFSDDTaNWTSSQaFCDSQDADLAQVES FQELNFLLRYKGPSDHWIGLSREQGQPWKWINGTEWTRQFPILG AGECAYLNDKGASSARCYTaRKWICSKSDIHVHHHHHHHH |
| SEQ ID 1002 | Human (Homo sapiens) CLEC2D construct 97 | MSFVSLLLVGILFHATQAQAACPESWIGFQRKCFYFSDDTKNWTSSQRFC DSQDADLAQVESFQELNFLLRYKGPSDHWIGLSREQGQPWKWI NGTEWTRQFPILGAGECAYLNDKGASSAaCaTEaKWICSKSDIHV HHHHHHHH |
| SEQ ID 1003 | Human (Homo sapiens) CLEC2D construct 98 | QAACPESWIGFQRKCFYFSDDTKNWTSSQRFCDSQDADLAQVE SFQELNFLLRYKGPSDHWIGLSREQGQPWKWINGTEWTRQFPIL GAGECAYLNDKGASSAaCaTEaKWICSKSDIHVHHHHHHHH |

Antibodies

In one embodiment, the term "antibody" refers to an immunoglobulin, which may be derived from natural sources or synthetically produced, in whole or in part. The terms "antibody" and "immunoglobulin" are used synonymously throughout the specification unless otherwise stated.

In one embodiment, the term "antibody" includes both polyclonal and monoclonal antibody preparations and also includes the following: chimeric antibody molecules, F(ab')2 and F(ab) fragments, Fv molecules, single chain Fv molecules (ScFv), dimeric and trimeric antibody fragments, bispecific antibody, minibodies, humanized monoclonal antibody molecules, human antibodies, fusion proteins comprising Fc region of antibody and any functional fragments arising out of these molecules, where derivative molecules retain immunological functionality of the parent antibody molecule. The antibody according to this disclosure is a human antibody, humanized antibody, chimeric antibody, or further genetically engineered antibody as long as the characteristic properties according to this disclosure are retained.

"Native antibodies and immunoglobulins" are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain. Particular amino acid residues are believed to form an interface between the light- and heavy-chain variable domains (Clothia et al., J. Mol. Biol. 186:651 (1985); Novotny and Haber, Proc. Natl. Acad. Sci. U.S.A. 82:4592 (1985)).

The term "antigen-binding site," or "binding portion" refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains, referred to as "hypervariable regions," are interposed between more conserved flanking stretches known as "framework regions," or "FRs". Thus, the term "FR" refers to amino acid sequences which are naturally found between, and adjacent to, hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs."

The term "variable" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called complementarity-determining regions (CDRs) or hypervariable regions both in the light-chain and the heavy-chain variable domains. The more highly conserved portions of variable domains are called the framework (FR). The variable domains of native heavy and light chains each comprise four FR regions, largely adopting a β-sheet configuration, connected by three CDRs, which form loops connecting, and in some cases forming part of, the β-sheet structure. The CDRs in each chain are held together in close proximity by the FR regions and, with the CDRs from the other chain, contribute to the formation of the antigen-binding site of antibodies (see Kabat et al., Sequences of Proteins of Immunological Interest, Fifth Edition, National Institute of Health, Bethesda, Md. (1991)). The constant domains are not involved directly in binding an antibody to an antigen, but exhibit various effector functions, such as participation of the antibody in antibody-dependent cellular toxicity.

"Antibody fragments" comprise a portion of a full length antibody, preferably the variable domain thereof, or at least the antigen binding site thereof scFv antibodies are, e.g., described in Huston, J. S., Methods in Enzymol. 203 (1991) 46-88. In one embodiment, "antibody fragment" is a portion of a whole antibody which retains the ability to exhibit antigen binding activity. In addition, antibody fragments comprise single chain polypeptides having the characteristics of a VH domain, namely being able to assemble together with a VL domain, or of a VL domain binding to the respective antigen being able to assemble together with a VH domain to a functional antigen binding site and thereby providing the properties of an antibody according to this disclosure.

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')2 fragment that has two antigen-combining sites and is still capable of cross-linking antigen.

"Fv" is the minimum antibody fragment which contains a complete antigen-recognition and binding site. This region consists of a dimer of one heavy- and one light-chain variable domain in tight, non-covalent association. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

A single chain Fv ("scFv") polypeptide molecule is a covalently linked VH:VL heterodimer, which can be expressed from a gene fusion including VH- and VL-encoding genes linked by a peptide-encoding linker. A number of methods have been described to discern chemical structures for converting the naturally aggregated, but chemically separated, light and heavy polypeptide chains from an antibody V region into an scFv molecule, which will fold into a three dimensional structure substantially similar to the structure of an antigen-binding site. See, e.g., U.S. Pat. Nos. 5,091,513; 5,132,405; and 4,946,778.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')2 antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa (k) and lambda (l), based on the amino acid sequences of their constant domains.

As used herein, the terms "immunological binding" and "immunological binding properties" refer to the non-covalent interactions of the type which occur between an immunoglobulin molecule and an antigen for which the immunoglobulin is specific. The strength, or affinity of immunological binding interactions can be expressed in terms of the dissociation constant (Kd) of the interaction, wherein a smaller Kd represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and geometric parameters that equally influence the rate in both directions. Thus, both the "on rate constant" (Kon) and the "off rate constant" (Koff) can be determined by calculation of the concentrations and the actual rates of association and dissociation. The ratio of Koff/Kon enables the cancellation of all parameters not related to affinity, and is equal to the dissociation constant Kd. In some embodiments, an antibody of the present disclosure binds to CLEC2D at a Kd≤10 µM, preferably ≤1 µM, more preferably ≤100 nM, for example, ≤90 nM, ≤80 nM, ≤70 nM, ≤60 nM, ≤50 nM, ≤40 nM, ≤30 nM, ≤20 nM, ≤10 nM, ≤5 nM, or ≤1 nM, as measured by assays such as radioligand binding assays or similar assays known to those skilled in the art. In some embodiment, the binding affinity of the antibody of this disclosure is within the range of $10^{-5}$ M to $10^{-12}$ M. For example, the binding affinity of the antibody of this disclosure is from $10^{-6}$ M to $10^{-12}$ M, from $10^{-7}$ M to $10^{-12}$ M, from $10^{-8}$ M to $10^{-12}$ M, from $10^{-9}$ M to $10^{-12}$ M, from $10^{-5}$ M to $10^{-11}$ M, from $10^{-6}$ M to $10^{-11}$ M, from $10^{-7}$ M to $10^{-11}$ M, from $10^{-8}$ M to $10^{-11}$ M, from $10^{-9}$ M to $10^{-11}$ M, from $10^{-10}$ M to $10^{-11}$ M, from $10^{-5}$ M to $10^{-10}$ M, from $10^{-6}$ M to $10^{-10}$, from $10^{-7}$ M to $10^{-10}$ M, from $10^{-8}$ M to $10^{-10}$, from $10^{-9}$ M to $10^{-10}$ M, from $10^{-5}$ M to $10^{-9}$ M, from $10^{-6}$ M to $10^{-9}$ M, from $10^{-7}$ M to $10^{-9}$ M, from $10^{-8}$ M to $10^{-9}$ M, from $10^{-5}$ M to $10^{-8}$ M, from $10^{-6}$ M to $10^{-8}$ M, from $10^{-7}$ M to $10^{-8}$ M, from $10^{-5}$ M to $10^{-7}$ M, from $10^{-6}$ M to $10^{-7}$ M or from $10^{-5}$ M to $10^{-6}$ M.

The present disclosure also features antibodies that have a specified percentage identity or similarity to the amino acid or nucleotide sequences of the CLEC2D antibodies described herein. For example, the antibodies may have at least 30%, 40%, 50%, 60%, 70%, 75%, 80%, 85%, 90%, 91%, 92%, 93%, 94%, 95%, 96%, 97%, 98%, 99%, or higher identity when compared a specified region or the full length of any one of the CLEC2D antibodies described herein. Preferably, the antibodies may have at least 60%, 70%, 75%, 80%, 85%, 90%, 91%, 92%, 93%, 94%, 95%, 96%, 97%, 98%, 99%, or higher identity when compared a specified region or the full length of any one of the CLEC2D antibodies described herein. More preferably, the antibodies may have at least 75%, 80%, 85%, 90%, 91%, 92%, 93%, 94%, 95%, 96%, 97%, 98%, 99%, or higher identity when compared a specified region or the full length of any one of the CLEC2D antibodies described herein. Even more preferably, the antibodies may have at least 90%, 91%, 92%, 93%, 94%, 95%, 96%, 97%, 98%, 99%, or higher identity when compared a specified region or the full length of any one of the CLEC2D antibodies described herein. Sequence identity or similarity to the nucleic acids and proteins of the present disclosure can be determined by sequence comparison and/or alignment by methods known in the art. For example, sequence comparison algorithms (i.e., BLAST or BLAST 2.0), manual alignment or visual inspection can be utilized to determine percent sequence identity or similarity for the nucleic acids and proteins of the present disclosure.

As to amino acid sequences, one of skill in the art will readily recognize that individual substitutions, deletions or additions to a nucleic acid, peptide, polypeptide, or protein sequence which alters, adds, deletes, or substitutes a single amino acid or a small percentage of amino acids in the encoded sequence is collectively referred to herein as a "conservatively modified variant". In some embodiments, the alteration results in the substitution of an amino acid with a chemically similar amino acid. Conservative substitution tables providing functionally similar amino acids are well known in the art.

Depending on the amino acid sequence of the constant domain of their heavy chains, immunoglobulins can be assigned to different classes. There are five major classes of immunoglobulins: IgA, IgD, IgE, IgG, and IgM, and several of these can be further divided into subclasses (isotypes), e.g., IgG1, IgG2, IgG3, IgG4, IgA1, and IgA2. The heavy-chain constant domains that correspond to the different classes of immunoglobulins are called α, ∂, ε, γ, and μ, respectively. The subunit structures and three-dimensional configurations of different classes of immunoglobulins are well known.

In one embodiment, a humanized antibody may be used in the compositions and methods provided herein. In some embodiments, the term "humanized antibody" or "humanized version of an antibody" refers to antibodies in which the framework or "complementarity determining regions" (CDR) have been modified to comprise the CDR of an immunoglobulin of different specificity as compared to that of the parent immunoglobulin. In other embodiments, the CDRs of the VH and VL are grafted into the framework region of human antibody to prepare the "humanized antibody." See e.g., Riechmann, L., et al, Nature 332 (1988) 323-327; and Neuberger, M. S., et al, Nature 314 (1985) 268-270. The heavy and light chain variable framework regions can be derived from the same or different human antibody sequences. The human antibody sequences can be the sequences of naturally occurring human antibodies. Human heavy and light chain variable framework regions are listed e.g., in Lefranc, M.-P., Current Protocols in Immunology (2000)—Appendix IP A.1P.1-A.1P.37 and are accessible via IMGT, the international ImMunoGeneTics information System® (http://imgt.cines.fr) or via http://vbase.mrc-cpe.cam.ac.uk. Optionally the framework region can be modified by further mutations. Particularly preferred CDRs correspond to those representing sequences recognizing the antigens noted above for chimeric antibodies. The term "humanized antibody" as used herein also comprises such antibodies which are modified in the constant region to generate the properties according to this disclosure, especially in regard to C1q binding and/or FcR binding, e.g., by "class switching" i.e., change or mutation of Fc parts (e.g., from IgG1 to IgG4 and/or IgG1/IgG4 mutation). The term "human antibody", as used herein, is intended to include antibodies having variable and constant regions derived from human germ line immunoglobulin sequences. Human antibodies are well-known in the state of the art (van Dijk, M. A., and van de Winkel, J. G., Curr. Opin. Chem. Biol. 5 (2001) 368-374). Human antibodies can also be produced in transgenic animals (e.g., mice) that are capable, upon immunization, of producing a full repertoire or a selection of human antibodies in the absence of endogenous immunoglobulin production. Transfer of the human germ-line immunoglobulin gene array in such germ-line mutant mice will result in the production of human antibodies upon antigen challenge (see, e.g., Jakobovits, A., et al, Proc. Natl. Acad. Sci. USA 90 (1993) 2551-2555; Jakobovits, A., et al, Nature 362 (1993) 255-258; Brueggemann, M. D., et al., Year Immunol. 7 (1993) 33-40). Human antibodies can also be produced in phage display libraries (Hoogenboom, H. R., and Winter, G., J. Mol. Biol. 227 (1992) 381-388; Marks, J. D., et al, J. Mol. Biol. 222 (1991) 581-597). The techniques of Cole, A., et al. and Boerner, P., et al. are also available for the preparation of human monoclonal antibodies (Cole, A., et al., Monoclonal Antibodies and Cancer Therapy, Liss, A. L., p. 77 (1985); and Boerner, P., et al, J. Immunol. 147 (1991) 86-95). As already mentioned for humanized antibodies according to this disclosure the term "human antibody" as used herein also comprises such antibodies which are modified in the constant region to generate the properties according to this disclosure.

In one embodiment, the term "monoclonal antibody" refers to an antibody composition having a homogeneous antibody population. The antibody is not limited to the species or source of the antibody or by the manner in which it is made. In another embodiment, the term encompasses whole immunoglobulins as well as fragments such as Fab, F(ab')2, Fv, and other fragments, as well as chimeric and humanized homogeneous antibody populations that exhibit immunological binding properties of the parent monoclonal antibody molecule. In another embodiment, the terms "monoclonal antibody" or "monoclonal antibody composition" as used herein refer to a preparation of antibody molecules of a single amino acid composition. In another embodiment, the terms Fab or ScFv are used as antibody fragments with specific mention.

In some embodiments, a chimeric antibody may be used in the compositions and methods provided herein. In one embodiment, the term "chimeric antibody" refers to a monoclonal antibody comprising a variable region, i.e., binding region, from one species (e.g., a mouse or rat) and at least a portion of a constant region derived from a different source or species (e.g., human), usually prepared by recombinant DNA techniques. Chimeric antibodies comprising a mouse variable region and a human constant region are especially preferred. Such chimeric antibodies are the product of expressed immunoglobulin genes comprising DNA segments encoding immunoglobulin variable regions from one species and DNA segments encoding immunoglobulin constant regions for a different species. Other forms of "chimeric antibodies" encompassed by the present disclosure are those in which the class or subclass has been modified or changed from that of the original antibody. Such "chimeric" antibodies are also referred to as "class-switched antibodies." Methods for producing chimeric antibodies involve conventional recombinant DNA and gene transfection techniques now well known in the art. See, e.g., Morrison, S. L., et al, Proc. Natl. Acad Sci. USA 81 (1984) 6851-6855; U.S. Pat. Nos. 5,202,238 and 5,204,244.

In one embodiment, "antibody display library" refers to a platform(s) expressing antibodies on the surface of a cell or cell-free suited for a screening methodology against target antigens. Herein, phage display library and yeast display library are used with accurate specification unless indicated otherwise.

In one embodiment, the term "naïve library" refers to a collection of nucleic acid sequences encoding a naturally occurring VH repertoire from a non-immunized source.

In one embodiment, the term "VH" refers to the single heavy chain variable domain of antibody of the type that can be found in mammals which are naturally devoid of light chains or parts of the same; Naive VH can be understood accordingly.

In one embodiment, the term "VL" refers to single light chain variable domain of the antibody; they are found in two types based on the constant domain sequence. Vk (with kappa constant region) and Vl (lambda constant region) are understood accordingly.

In one embodiment, the term "CDR" refers to complementary determining region of the antibody structure.

In one embodiment, the term "repertoire," means a collection, indicating genetic diversity.

In one embodiment, the term "framework region" is used herein to refer to the nucleic acid sequence regions of an antibody molecule that encode the structural elements of the molecule.

In another embodiment, the term "vector" refers to a DNA related to a cloning or expression system to accommodate antibody genes in specific designated restriction sites. Phagemid vectors (applicable to phage display systems) or yeast vectors (applicable to yeast display systems) are understood accordingly or mammalian expression vectors (applicable to mammalian expression systems).

The disclosure provides antibodies and antibody fragments that bind to a CLEC2D antigen of the disclosure.

The disclosure provides VH and VL domains of antibodies or antibody fragments that bind to a CLEC2D antigen or an epitope of CLEC2D as described in the disclosure.

The disclosure provides sequences of CDR1, CDR2 and CDR3 of the VH domain and CDR1, CDR2 and CD3 of the VL domain of antibodies that bind to a CLEC2D antigen or an epitope of CLEC2D as described in the disclosure.

Any combinations of VH and VL sequences of the disclosure are considered within the scope of this disclosure. Any combinations of the CDR1, CDR2 and CDR3 sequences of the VH domains, or the CDR1, CDR2 and CD3 sequences of the VL domains are considered within the scope of this disclosure.

Those skilled in the art will recognize that it is possible to determine, without undue experimentation, if a monoclonal antibody has the same specificity as a monoclonal antibody of the disclosure by ascertaining whether the former prevents the latter from binding to CLEC2D. If the monoclonal antibody being tested competes with the monoclonal antibody of the disclosure, as shown by a decrease in binding by the monoclonal antibody of the disclosure, then it is likely that the two monoclonal antibodies bind to the same, or to a closely related, epitope.

Another way to determine whether a monoclonal antibody has the specificity of a monoclonal antibody of the disclosure is to pre-incubate the monoclonal antibody of the disclosure with the CLEC2D protein, with which it is normally reactive, and then add the monoclonal antibody being tested to determine if the monoclonal antibody being tested is inhibited in its ability to bind CLEC2D. If the monoclonal antibody being tested is inhibited then, in all likelihood, it has the same, or functionally equivalent, epitopic specificity as the monoclonal antibody of the disclosure. Screening of monoclonal antibodies of the disclosure can be also carried out by utilizing CLEC2D and determining whether the test monoclonal antibody is able to neutralize CLEC2D.

Various procedures known within the art may be used for the production of polyclonal or monoclonal antibodies directed against a protein of the disclosure, or against derivatives, fragments, analogs homologs or orthologs thereof. (See, for example, Antibodies: A Laboratory Manual, Harlow E, and Lane D, 1988, Cold Spring Harbor Laboratory Press, Cold Spring Harbor, NY, incorporated herein by reference).

Antibodies can be purified by well-known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia PA, Vol. 14, No. 8 (Apr. 17, 2000), pp. 25-28).

Monoclonal antibodies can be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, Monoclonal Antibodies: Principles and Practice, Academic Press, (1986) pp. 59-103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, California and the American Type Culture Collection, Manassas, Virginia Human myeloma and mouse-human heteromyeloma cell lines also have been described for the production of human monoclonal antibodies. (See Kozbor, J. Immunol., 133:3001 (1984); Brodeur et al., Monoclonal Antibody Production Techniques and Applications, Marcel Dekker, Inc., New York, (1987) pp. 51-63)).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (MA) or enzyme-linked immunoabsorbent assay (ELISA). Such techniques and assays are known in the art. The binding affinity of the monoclonal antibody can, for example, be determined by the Scatchard analysis of Munson and Pollard, Anal. Biochem., 107:220 (1980). Moreover, in therapeutic applications of monoclonal antibodies, it is important to identify antibodies having a high degree of specificity and a high binding affinity for the target antigen.

After the desired hybridoma cells are identified, the clones can be subcloned by limiting dilution procedures and grown by standard methods. (See Goding, Monoclonal Antibodies: Principles and Practice, Academic Press, (1986) pp. 59-103). Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

Monoclonal antibodies can also be made by recombinant DNA methods, such as those described in U.S. Pat. No. 4,816,567. DNA encoding the monoclonal antibodies of the disclosure can be readily isolated and sequenced using conventional procedures (e.g., by using oligonucleotide probes that are capable of binding specifically to genes encoding the heavy and light chains of murine antibodies). In some embodiments, the hybridoma cells of the disclosure serve as a source of such DNA. In some embodiments, antibody gene sequences are isolated and cloned using the methods of the disclosure (e.g., phage and yeast library display), and serve as the source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (see U.S. Pat. No. 4,816,567; Morrison, Nature 368, 812-13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the disclosure, or can be substituted for the variable domains of one antigen-combining site of an antibody of the disclosure to create a chimeric bivalent antibody.

All cell lines suitable for the expression and purification of antibodies or antibody fragments are considered to be within the scope of the disclosure. In some embodiments, the cell line is a mammalian cell line. Cell lines can be isolated or derived from any source, including human, mouse and hamster. Suitable cell lines include, but are not limited to, Chinese Hamster Ovary (CHO) cells, HEK 293 cells, HEK293T cells, BHK21 cells, NSO cells, PER.C6 cells, B cells, HEK 293-6E cells, Sp2/0-Ag14 cells and DG44 cells. In some embodiments, the cell line is a hybridoma cell line.

The antibody can be expressed by a vector containing a DNA segment encoding the single chain antibody described herein.

These can include vectors, liposomes, naked DNA, adjuvant-assisted DNA, gene gun, catheters, etc. Vectors include chemical conjugates such as described in WO 93/64701, which has targeting moiety (e.g., a ligand to a cellular surface receptor), and a nucleic acid binding moiety (e.g., polylysine), viral vector (e.g., a DNA or RNA viral vector), fusion proteins such as described in PCT/US 95/02140 (WO 95/22618) which is a fusion protein containing a target moiety (e.g., an antibody specific for a target cell) and a nucleic acid binding moiety (e.g., a protamine), plasmids, phage, etc. The vectors can be chromosomal, non-chromosomal or synthetic.

Preferred vectors include viral vectors, fusion proteins and chemical conjugates. Retroviral vectors include moloney murine leukemia viruses. DNA viral vectors are preferred. These vectors include pox vectors such as orthopox or avipox vectors, herpesvirus vectors such as a herpes simplex I virus (HSV) vector (see Geller, A. I. et al., J. Neurochem, 64:487 (1995); Lim, F., et al., in DNA Cloning: Mammalian Systems, D. Glover, Ed. (Oxford Univ. Press, Oxford England) (1995); Geller, A. I. et al., Proc Natl. Acad. Sci.: U.S.A. 90:7603 (1993); Geller, A. I., et al., Proc Natl. Acad. Sci USA 87:1149 (1990), Adenovirus Vectors (see LeGal LaSalle et al., Science, 259:988 (1993); Davidson, et al., Nat. Genet 3:219 (1993); Yang, et al., J. Virol. 69:2004 (1995) and Adeno-associated Virus Vectors (see Kaplitt, M. G. et al., Nat. Genet. 8:148 (1994).

Pox viral vectors introduce the gene into the cells cytoplasm. Avipox virus vectors result in only a short term expression of the nucleic acid. Adenovirus vectors, adeno-associated virus vectors and herpes simplex virus (HSV) vectors are preferred for introducing the nucleic acid into neural cells. The adenovirus vector results in a shorter term expression (about 2 months) than adeno-associated virus (about 4 months), which in turn is shorter than HSV vectors. The particular vector chosen will depend upon the target cell and the condition being treated. The introduction can be by standard techniques, e.g., infection, transfection, transduction or transformation. Examples of modes of gene transfer include e.g., naked DNA, CaPO4 precipitation, DEAE dextran, electroporation, protoplast fusion, lipofection, cell microinjection, and viral vectors.

Exemplary VH amino acid sequences of CLEC2D antibodies of the disclosure are shown in Table 2 below. VH amino acid sequences having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to the sequences listed in Table 2 are considered within the scope of the disclosure.

TABLE 2

| VH Amino Acid Sequences | |
|---|---|
| SEQ ID | VH Amino Acid Sequence |
| SEQ ID 1 | EVQLVQSGAEVKKPGASVKVSCKASGYTFTSYAMHWVRQAPGQRLEWMGWINAGNGNTKYSQKFQGRVTI<br>TRDTSASTAYMELSSLRSEDTAVYYCARGSLSRSGWYAGLFDYWGQGTLVTVSS |
| SEQ ID 2 | QITLKESGGGVVQPGRSLRLSCAASGFTFSSYSMNWVRQAPGKGLQWVAIISDDGSKSYYADSVQGRFTISRD<br>NSRNTVFLQMNSLRAEDTAMYYCARDRGTKWNQLNDVFDMWGQGTMVTVSS |
| SEQ ID 3 | EVQLVQSGAEVKKPGASVKVSCKASGYTFTSYYMHWVRQAPGQGLEWMGIINPSGGSTSYAQKFQGRVTMT<br>RDTSTSTVYMELSSLRSEDTAVYYCARGRGYSSSRLYYFDYWGQGTLVTVSS |
| SEQ ID 4 | QVTLKESGGGLVRPGGSLRLSCEASGFTFSDPYMDWVRQAPGKGLEWVGRITNKRTGYATTYAASVKDRFTIS<br>RDDSRKSVYLQMNSLKTEDTAVYYCATDVSGSFAAYGGQGTLVTVSS |
| SEQ ID 5 | EVQLVQSGGGVVQPGRSLRLSCAASGFTFSSYAMHWVRQAPGQRLEWMGWINAGNGNTKYSQKFQGRVTI<br>TRDTSASTAYMELSSLRSEDTAVYYCAGEGGAVAGTVYWGQGTLVTVSS |
| SEQ ID 6 | QVQLVQSGGGLVKPGGSLRLSCAASGFTFSNAWMSWVRQAPGKGLEWVGRIKSKTDGGTTDYAAPVKGRFT<br>ISRDDSKNTLYLQMNSLKTEDTAVYYCTIDEYFYWGQGTLVTVSS |
| SEQ ID 7 | QVQLQQWGAGLLKPSETLSLTCAVYGGSFSGYYWSWIRQPPGKGLEWIGEINHSGSTNYNPSLKSRVTISVDTS<br>KNQFSLKLSSVTAADTAVYYCARVNPGSYTREVSNFDYWGQGTLVTVSS |
| SEQ ID 8 | QVQLQQSGPELVKPSQTLTLICGISGDSVSSNSVTWNWVRQSPSRGLEWLGRTYYRSQWYYNYAVSVKSRITI<br>SPDTSKNQFSLQLNSVTPEDTAVYYCATRGHNYGVDYWGPGTTVTVSS |
| SEQ ID 9 | QVQLVQSGGGLVKPGGSLRLSCAASGFTFSNAWMSWVRQAPGKGLEWVCRIKSKTDGETTDYAAPVKGRFTI<br>SRDDSKNTLYLQMNSLKTEDTAVYHCTTGVGWSPFQYWGQGTLVTVSS |
| SEQ ID 10 | EVQLVQSGGGLVQPGRSLRLSCTASGFTFGDYAMSWFRQAPGKGLEWVGFIRSKAYGGTTEYAASVKGRFTIS<br>RDDSKSIAYLQMNSLKTEDTAVYYCTRDDKIAAAGFTYWYFDLWGRGTLVTVSS |
| SEQ ID 11 | QVQLVQSGAEVKKPGASVKVSCKASGYTFAAYYLHWVRQAPGQGLEWMGRISPGNGVTSYAQKFQGRVTM<br>TGDTSINTVYMQLNNLISGDTAVYYCAREAADDPFDHWGQGALVTVSS |
| SEQ ID 12 | EVQLVQSGGGVVQPGRSLTLSCAASGFTFSSHLMHWVRQAPGKGLEWVAVISYDGTSKYYGDSVKGRFTISRD<br>NSKNTLYLQMNSLRAEDTAIYYCAKADYKYDWGQGTLVTVSS |
| SEQ ID 13 | EVQLVQSGGGLVKPGGSLRLSCTASGFTFGDYAMSWVRQAPGKGLEWVGFIRSKAYGGTTEYAASVKGRFTIS<br>RDDSKSIAYLQMNSLKTEDTAVYYCTTHRRPIYDILTGFDYWGQGTLVTVSS |
| SEQ ID 14 | QLQLQESGGGLVQPGRSLRLSCTASGFTFGDYAMSWVRQAPGKGLEWVGFIRSKAYGGTTEYAASVKGRFTIS<br>RDDSKSIAYLQMNSLKTEDTAVYYCTREDTMVRGVIPWGQGTLVTVSS |
| SEQ ID 15 | QLQLQESGSGLVKPSQTLSLTCAVSGGSISSGGYSWSWIRQPPGKGLEWIGYIYHSGSTYYNPSLKSRVTISVDRS<br>KNQFSLKLSSVTAADTAVYYCARDRRYYDSSGYYPAYYFDYWGQGTLVTVSS |
| SEQ ID 16 | EVQLVQSGGGLVKPGGSLRLSCAASGFTFSSYSMNWVRQAPGKGLEWVSYISSSGSYTNYADSVKGRFTISRD<br>NAKNSLYLQINSLRAEDTAIYYCARDGGYDSSGFHFDYWGQGTLVTVSS |
| SEQ ID 17 | QVQLQQSGPGLVKPSQTLSLTCAISGDSVSNNRAAWNWIRQSPSRGLEWLGRTYYRSKWYNEYAVSVKSRITI<br>NPDTSKNQFSLQLNSMTPEDSAVYYCAILPSSGYLQDHHYYGMDVWGQGTTVTVSS |
| SEQ ID 18 | EVQLVQSGAEVKKPGASVKVSCKASGYTFTSYGISWVRQAPGQGLEWMGWISAYNGNTNYAQKLQGRVTM<br>TTDTSTSTAYMELSSLRSEDTAVYYCARAAVGDGYSYGRLDWGQGTLVTVSS |
| SEQ ID 19 | EVQLVQSGAEVKKPGESLKISCKGSGYSFTSYWIGWVRQMPGKGLEWMGIIYPGDSDTRYSPSFQGQVTISAD<br>KSISTAYLQWSSLKASDTAMYYCARLPSYYYDSSGYFTWYFDLWGRGTLVTVSS |
| SEQ ID 20 | EVQLVQSGAEVKKPGASVKVSCKASGYTFTSYGISWVRQAPGQGLEWMGWIIPIFGIANYAQKFQGRVTITAD<br>KSTSTAYMELSSLRSEDTAVYYCARELYNYGSKDYFDYWGQGTLVTVSS |
| SEQ ID 21 | EVQLVQSGAEVKKPGESLKISCKGSGYSFTSYWIGWVRQMPGKGLEWMGIIYPGDSDTRYSPSFQGQVTISAD<br>KSISTAYLQWSSLKASDTAMYYCARGGTWDTAMVTGFDYWGQGTLVTVSS |
| SEQ ID 22 | EVQLVQSGAEVKKPGESLKISCKGSGYSFTSYWIAWVRQMPGKGLEWMGVIYPGDSDTRYSPSFQGQVTISAD<br>KSINTAYLQWSSLKASDTAMYYCARPHYDILTGSRAPFDYWGQGTLVTVSS |
| SEQ ID 23 | QVQLQQWGAGLLKPSETLSLTCAVYGGSFSGYYWSWIRQPPGKGLEWIGEINHSGSTNYNPSLKSRVTISVDTS<br>KNQFSLKLSSVTAADTAVYYCARARVESKDGYFDYWGQGTLVTVSS |
| SEQ ID 24 | EVQLVESGGGVVQPGRSLRLSCAASGFTFTDAWMNWVRQAPGKGLEWIGRVKNKADGETTDYAAPVKGRIT<br>ISRDDAKNTLYVQMNSLKTEDTAVYYCTADLRLSTWDAYDFWGQGTMVTVSS |
| SEQ ID 25 | QITLKESGGGLVQPGGSLRLSCTVSGFTFSNNWMTWVRQTPGKGLEWVANIKQDGTEKHYVDSVKGRFTISR<br>DNAENSLYLQMNSLRGEDTAVYYCARNSQRSFDYWGQGTLVTVSS |

TABLE 2-continued

| VH Amino Acid Sequences | |
|---|---|
| SEQ ID | VH Amino Acid Sequence |
| SEQ ID 26 | QVTLKESGGGVVQPGRSLRLSCAASGFTFSSYGMHWVRQAPGKGLEWVAVISYDGSNKYYADSVKGRFTISR<br>DNSKNTLYLQMNSLRAEDTAVYYCAKDLGDPRGGILNYWGQGTLVTVSS |
| SEQ ID 27 | EVQLVESGGGVVQPGRSLRLSCAASGFTFSSYAMHWVRQAPGKGLEWVAVISYDGSNKYYADSVKGRFTISRD<br>NSKNTLYLQMNSLRAEDTAVYYCARSSPWGELSLYQGAFDIWGQGTMVTVSS |
| SEQ ID 28 | QITLKESGGGLVQPGRSLRLSCAASGFTFDDYAMHWVRQAPGKGLEWVSAISGSGGSTYYADSVKGRFTISRD<br>NSKNTLYLQMNSLRAEDTAVYYCAKDNDFWSGKVFDYWGQGTLVTVSS |
| SEQ ID 29 | EVQLVQSGGGLVQPGGSLRLSCAASGFTFSSYSMNWVRQAPGKGLEWVSYISSTSSTIYYADSVKGRFTISRDN<br>SKNMLFLQMNSLRAEDTAVYYCAKEGGSGWRHYFDYWGQGTLVTVSS |
| SEQ ID 30 | QVTLKESGGGVVQPGRSLRLSCAASGFTFSSYAMHWVRQAPGKGLEWVAVISYDGSNKYYADSVKGRFTISRD<br>NSKNTLYLQMNSLRAEDTAVYYCARDYCSSTSCQNWFDPWGQGTLVTVSS |
| SEQ ID 31 | QVQLVQSGGGLVQPGGSLRLSCAASGFTFSNYVMSWVRQAPGKGLEWVSAISGIGDTTYYADSVKGRFTISRD<br>NAKNTLYLQMNSLRAEDTAVYYCARGRVAGDAFDIWGQGTMVTVSS |
| SEQ ID 32 | QLQLQESGGGLVQPGGSLRLSCAASGFTFSSYAMSWVRQAPGKGLEWVSAISGSGGSTYYADSVKGRFTISRD<br>NSKNTLYLQMNSLRAEDTAVYYCAKDQGAAAGTLGYFDYWGQGTLVTVSS |
| SEQ ID 33 | QVQLVQSGAEVKKPGASVKVSCKASGYTFTSYDINWVRQATGQGLEWMGWMNPNSGNTGYAQKFQGRVT<br>MTRNTSISTAYMELSSLRSEDTAVYYCTRGIYDSSGSSNPFDSWGQGTLVTVSS |
| SEQ ID 34 | EVQLVQSGAEVKKPGASVKISCEASGYTFTDYAIHWVRQAPGQRLEWMGWINAGDGGTKSSREFQGRVTITR<br>DTSATTAYMEVSSLRSEDTAVYYCARGYCSGGSCPGTDFDYWGQGTLVTVSS |
| SEQ ID 35 | QVQLVQSGAEVKKPGASVKVSCKASGYTFTSYYMHWVRQAPGQGLEWMGIINPSGGSTSYAQKFQGRVTM<br>TRDTSTSTVYMELSSLRSEDTAVYYCARDGVGGRDGYNFDYWGQGTLVTVSS |
| SEQ ID 36 | EVQLVQSGGGLVQPGGSLRLSCAASGFTVSSNYMSWVRQAPGKGLEWVSVIYSGGSTYYADSVKGRFTISRDN<br>SKNTLYLQMNSLRAEDTAVYYCARAPLAADGYFDYWGQGTLVTVSS |
| SEQ ID 37 | EVQLVQSGAEVKKPGSSVKVSCKASGGTFSSYAISWVRQAPGQGLEWMGGIIPIFGTANYAQKFQGRVTITAD<br>ESTSTAYMELSSLRSEDTAVYYCARARGLQYLIWYFDLWGRGTLVTVSS |
| SEQ ID 38 | QVQLVQSGAEVKKPGASVKVSCKASGYTFTSYYMHWVRQAPGQGLEWMGIINPSGGSTSYAQKFQGRVTM<br>TRDTSTSTVYMELSSLRSEDTAVYYCASPGMVRGVITAPLDYWGQGTLVTVSS |
| SEQ ID 39 | EVQLVQSGGGLVKPGGSLRLSCAASGFTFSSYAISWVRQAPGQGLEWMGGIIPMYGTANYAQKFQGRVTITA<br>DESTSTAYMELSSLRSEDTALYYCAREAKWGMYYFDYWGQGTLVTVSS |
| SEQ ID 40 | EVQLVESGGGVVQPGRSLRLSCAASGFTFSSYAIHWVRQAPGKGLEWVAIISDDGSKSYYADSVQGRFTISRDN<br>SRNTVYLQMNSLRAEDTAMYYCARDRGTKWNQLNDVFDMWGQGTMVTVSS |
| SEQ ID 41 | QMQLVQSGAEVKKPGASVKVSCTASGYTFTSSDINWVRQATGQGLEWMGWMNPNSGNTGYAEKFQGRVT<br>MTSDSSISTAYMELRSLTTEDTAVYYCARGGGASYTDSWGQGTLVTVSS |
| SEQ ID 42 | QVQLVQSGGGLVQPGRSLRLSCTASGFTGDYAMSWFRQAPGKGLEWVGEIRSKAYGGTTEYAASVKGRFTIS<br>RDDSKSIAYLQMNSLKTEDTAVYYCTAKGGYVGYSYGPFGGYWGQGTLVTVSS |
| SEQ ID 43 | QVQLVQSGGGLVQPGRSLRLSCTASGFTGDYAMSWFRQAPGKGLEWVGEIRSKAYGGTTEYAASVKGRFTIS<br>RDDSKSIAYLQMNSLKTEDTAVYYCTRGGTMVRGFGFNYWGQGTLVTVSS |
| SEQ ID 44 | QVQLQQWGAGLLKPSETLSLTCAVYGGSFSGYYWSWIRQPPGKGLEWIGEINHSGSTNYNPSLKSRVTISVDTS<br>KNQFSLKLSSVTAADTAVYYCARARRAMIGPLPRLVGYFDLWGRGTLVTVSS |
| SEQ ID 45 | QVQLQQWGAGLLKPSETLSLTCAVYGGSFSGYYWSWIRQPPGKGLEWIGEINHSGSTNYNPSLKSRVTISVDTS<br>KNQFSLKLSSVTAADTAVYYCARGRPAPSWVKTRNWFDPWGQGTLVTVSS |
| SEQ ID 46 | QVQLQQSGPGLVKPSQTLSLTCAISGDSVSSNSAAWNWIRQSPSRGLEWLGRTYYRSKWYNDYAVSVKSRITI<br>NPDTSKNQFSLQLNSVTPEDTAVYYCAREASSGWNWGQGTLVTVSS |
| SEQ ID 47 | QVQLQESGPGLVKPSQTLSLTCAISGDSVSSNNAAWNWIRQSPSRGLEWLGRTFYRSKWYNDYAVSVKSRLTV<br>NPDTSKNQFSLRLNSVSPEDTAVYYCARGGRYTKGGYFDDWGQGTLVTVSS |
| SEQ ID 48 | QVTLKESGPTLVKPTQTLTLICTFSGFSLSTSGVGVGWIRQPPGKALEWLALIYWDDDKRYSPSLKSRLTITKDTS<br>KNQVVLTMTNMDPVDTATYYCAHRLDSSGRGGYFDYWGQGTLVTVSS |
| SEQ ID 49 | EVQLVESGGGVVQPGRSLRLSCTASGFTFSSYGMHWVRQAPGKGLEWVAVISYDGSNKYYADSVKGRFTISRD<br>NSKNTLYLQMNSLRAEDTAVYYCAKELVGTSSPYYYYYGMDVWGQGTMVTVSS |
| SEQ ID 50 | QLQLQESGGGLVQPGGSLRLSCAASGFTVSSNYMSWVRQAPGKGLEWVSVIYSGGSTYYADSVKGRFTISRDN<br>SKNTLYLQMNSLRAEDTAVYYCARDYYYGSGSSPWGQGTLVTVSS |

TABLE 2-continued

VH Amino Acid Sequences

| SEQ ID | VH Amino Acid Sequence |
|---|---|
| SEQ ID 51 | QVQLQQWGAGLLKPSETLSLTCAVYGGSFSGYYWSWIRQPPGKGLEWIGEINHSGSTNYNPSLKSRVTISVDTS KNQFSLKLSSVTAADTAVYYCARGRPYCSSTSCYPEWFDPWGQGTLVTVSS |
| SE ID 52Q | QVTLKESGGGVVQPGRSLRLSCAASGFTFSSYGMHWVRQAPGKGLEWVAVISYDGSNKYYADSVKGRFTISR DNSKNTLYLQMNSLRAEDTAVYYCAKLRGIDYYDSSGYQRGFDYWGQGTLVTVSS |
| SEQ ID 53 | QVQLQESGPGLVKPSETLSLTCTVSGGSISSYYWSWIRQPPGKGLEWIGYIYYTGSTNYNPSLKSRVTISVDTSKN QFSLKLSSVTTADTAVYYCARGGRGDGAAFDIWGQGTMVTVSS |
| SEQ ID 54 | QVQLVQSGGGVVQPGRSLRLSCAASGFTFSSSAMHWVRQAPGKGLEWVAMIWHDESKKYYADSVKGRFTIS RDNSKNTLYLQMNSLRAEDTAVYYCARPPDGGNSGRWYFDLWGRGTLVTVSS |
| SEQ ID 55 | QMQLVQSGGGLVQPGGSLRLSCAASGFTFSSYAMSWVRQAPGKGLEWVSAISGSGGSTYYADSVKGRFTISR DNSKNTLYLQMNSLRAEDTAVYYCAKDKNVRKHDYGDHPYGGYFDYWGQGTLVTVSS |
| SEQ ID 56 | EVQLVQSGAEVKKPGASVKVSCKASGYTFTSYAMHWVRQAPGQRLEWMGWINAGNGNTKYSQKFQGRVTI TRDTSASTAYMELSSLRSEDTAVYYCARVAGATSLWYWGQGTLVTVSS |
| SEQ ID 57 | QVQLQQSGPGLVKPSQSLSLTCAISGDSVSSNSAAWNWIRQSPSRGLEWLGRTYYRSKWYNDYAVSVKSRITIK PDTSKNQFSLQLNSVTPEDTAVYYCTRLANSDGVDVWGQGTMVTVSS |
| SEQ ID 58 | QVQLQQSGPGLVKPSQTLSLTCAISGDSVSSDAVWTWIRQSPSRGLEWLGRTYYKSKWYNDYAASVKSRITIN PDTSKNQFSLHLNSVTPEDTAVYYCARGVTRTFDYWGQGTTVTVSS |
| SEQ ID 59 | QLQLQESGPGLVKPSQTLSLTCAISGDSVSSNSAAWNWIRQSPSRGLEWLGRTYYRSKWYNDYAVSVKSRITIN PDTSKNQFSLQLNSVTPEDTAVYYCAEGNGPFDPWGQGTLVTVSS |
| SEQ ID 60 | QITLKESGGGVVQPGRSLRLSCVASGFTFSTYPMHWVRQAPGKGLEWVAVISYDGRNEYYADSVKGRFTISRD NSKNTLYLQMNSLRAEDTAVYYCATRDTPLVGVSIYWGQGTLVTVSS |
| SEQ ID 61 | QMQLVQSGGGLVKAGGSLRLSCSASGFTFSSYAMHWVRQAPGKGLEYVSAISSNGGSTYYADSVKGRFTISRD NSKNTLYLQMSSLRAEDTAVYYCVNRAGYGDYRHFQHWGQGTLVTVSS |
| SEQ ID 62 | EVQLVQSGGGVVQPGGSLRLSCAASGFTFSSYGMHWVRQAPGKGLEWVAFISYDGSNKYYADSVKGRFTISR DNSKNTLYLQMNSLRAEDTAVYYCATTGDRFQEFDYWGQGTLVTVSS |
| SEQ ID 63 | QMQLVQSGGVLLQPGRSLRLSCTASGFTAAYNINWFRQGPGGGLEWVGEIRANADSGTTEYAASVKGRFFIS RDDSRSTAYLQMTSLKTEDTAVYYCARDDRGRGDDFDYWGQGTLVTVSS |
| SEQ ID 64 | QVQLVQSGGGLVQPGGSLRLSCAASGFTFSSYGMTWVRQAPGKGLEWVSTISGNGVGTYYPDSVKDRFTISR DSSKNTVYLQMNSLRAEDTAVYYCVKHGRAGINWYFDLWGRGTLVTVSS |
| SEQ ID 65 | QVQLQQSGPGLVKPSQTLSLTCAISGDSVSSNSAAWNWIRQSPSRGLEWLGRTYYRSKWYNDYAVSVKSRITI NPDTSKNQFSLQLNSVTPEDTAVYYCARGGGLWAFDIWGQGTTVTVSS |
| SEQ ID 66 | EVQLVQSGAEVKKPGASVKVSCKASGYTFTGYYMHWVRQAPGQGLEWMGWINPNSGGTNYAQKFQGRVT MTRDTSISTAYMELSRLRSDDTAVYYCARDKIGSCPYWGQGTLVTVSS |
| SEQ ID 67 | QVTLKESGPTLVKPTQTLTLICTFSGFSLSTSGVGVGWIRQPPGKALEWLALIYWDDDKRYSPSLKSRLTITKDTS KNQVVLTMTNMDPVDTATYYCAHRPDSSSQCFDYWGQGTLVTVSS |
| SEQ ID 68 | QVTLKESGGGVVQPGRSLRLSCAASGFTFSSYAMHWVRQAPGKGLEWVAVISYDGSNKYYADSVKGRFTISRD NSKNTLYLQMNSLRAEDTAVYYCARSSGWSLPEDYWGQGTLVTVSS |
| SEQ ID 69 | QVQLVQSGAEVKKPGASVKVSCKVSGYTLTELSMHWVRQAPGKGLEWMGGFDPEDGETIYAQKFQGRVTM TEDTSTDTAYMELSSLRSEDTAVYYCATDVNPELLGAGFDYWGQGTLVTVSS |
| SEQ ID 70 | QVTLKESGGGLVQPGGSLRLSCAASGFTFSDQYMDWVRQAPGKGLEWVGRVRNKANSYTTEYAASVKGRFTI SRDDSKNSLYLQMNSLNTEDTAMYFCASSLNSGGYRCFHHWGQGTLVTVSS |
| SEQ ID 71 | QVQLVQSGGGLVQPGGSLRLSCSASGFTFSSYAMHWVRQAPGKGLEYVSAISSNGGSTYYADSVKGRFTISRD NSKNTLYLQMSSLRAEDTAVYYCVKAPRGVVPAAMRGGYWGQGTLVTVSS |
| SEQ ID 72 | QVQLQESGGGLVQPGRSLRLSCTASGFTFGDYAMSWFRQAPGKGLEWVGEIRSKAYGGTTEYAASVKGRFTIS RDDSKSIAYLQMNSLKTEDTAVYYCTRLVGNSGSYYPFGYWGQGTLVTVSS |
| SEQ ID 73 | QVQLQQWGAGLLKPSETLSLTCAVYGGSFSGYYWSWIRQPPGKGLEWIGEINHSGSTNYNPSLKSRVTISVDTS KNQFSLKLSSVTAADTAVYYCARGRSLPYRGLAPRSEGGYYFDYWGQGTLVTVSS |
| SEQ ID 74 | QVQLQESGGGLVRPGGSLRLSCGDSGFNFSGYEMNWVRQAPGKGLEWVSYVSTSGSTRYYADSVKGRFTISR DNAKNTLYLQMNSLRVEDTAVYYCARGRTHWGPQDFDYWGQGTLVTVSS |
| SEQ ID 75 | QVQLQESGGGLVQPGGSLRLSCAASGFTFSSYAMSWVRQAPGKGLEWVSAISGSGGSTYYADSVKGRFTISRD NSKNTLYLQMNSLRAEDTAVYYCAKGGMYYYGSGSSYFDYWGQGTLVTVSS |

TABLE 2-continued

VH Amino Acid Sequences

| SEQ ID | VH Amino Acid Sequence |
|---|---|
| SEQ ID 76 | QVQLVQSGGGLVQPGGSLRLSCAASGFTFSSYAMSWVRQAPGKGLEWVSGISGSGGSTYYADSVKGRFTISR<br>DNSKNMLFLQMNSPRAEDTAVYYCAKKIAAAGKQPVDYWGQGTLVTVSS |
| SEQ ID 77 | QVQLQQWGAGLLKPSETLSLTCAVGGSFSGYYWSWIRQPPGKGLEWIGEINHSGSTNYNPSLKSRVTISVDTS<br>KNQFSLKLSSVTAADTAVYYCARRKVYDYVWGSYRLPGSVSYYFDYWGQGTLVTVSS |
| SEQ ID 78 | QVQLVQSGAEVKKPGESLKISCKGSGYSFTSYWIGWVRQMPGKGLEWMGIIYPGDSDTRYSPSFQGQVTISAD<br>KSISTAYLQWSSLKASDTAMYYCARLPGRAARPDYWGQGTLVTVSS |
| SEQ ID 79 | QVTLKESGGGVVQPGRSLRLSCAASGFTFSSYAMHWVRQAPGKGLEWVAVISYDGSNKYYADSVKGRFTISRD<br>NSKNTLYLQMNSLRAEDTAVYYCARGPGAVAGTKPKYYFDYWGQGTLVTVSS |
| SEQ ID 80 | EVQLVQSGGGVVQPGRSLRLSCAASGFTFSSYAMHWVRQAPGKGLEWVAVISYDGSNKYYADSVKGRFTISR<br>DNSKNTLYLQMNSLRAEDTAVYYCARATYYYDSSGYRFDYWGQGTLVTVSS |
| SEQ ID 81 | EVQLVQSGGGLVEPGGSLRLSCAASRFTFSDAWMSWVRQAPGKGLEWVGRIKSKISGGTTDYAAPVQGRFTI<br>SRDDSKNTLYLQMDSLKTEDTAVYYCANRNLGYWGQGTLVTVSS |
| SEQ ID 82 | EVQLVQSGAEVKKPGASVKVSCKASGYTFTSYAMHWVRQAPGQRLEWMGWINAGNGNTKYSQKFQGRVT<br>MTTDTSTSTAYMELRSLRSDDTAVYYCARARYYDSSGYIAPSGYFDYWGQGTLVTVSS |
| SEQ ID 83 | QVQLVQSGAEVKKPGASVKVSCKASGYTFTSYAMHWVRQAPGQRLEWMGWINAGNGNTKYSQKFQGRVT<br>ITRDTSASTAYMELSSLRSEDTAVYYCARDGPAVDGAEYFQHWGQGTLVTVSS |
| SEQ ID 84 | QLQLQESGPGLVKPSQTLSLTCAISGDSVSSNSAAWNWIRQSPSRGLEWLGRTYYRSKWYNDYAVSLKSRITIN<br>PDTSKNQFSLQLNSVTPEDTAVYYCASLASGSPPPGDYWGQGTLVTVSS |
| SEQ ID 85 | QVTLKESGGGVVQPGRSLRLSCAASGFTFSTYGMHWVRQAPGKGLEWVALISYDGSKKYYANSVKGRFTISRD<br>NSKNTLYLQMKSLRAEDTAMYYCAKGPIVGATMDYWGQGALVTVSS |
| SEQ ID 86 | EVQLVQSGAEVKKPGSSVKVSCKASGGTFSSYAISWVRQAPGQGLEWMGWISAYNGNTNYAQKLQGRVTM<br>TTDTSTSTAYMELRSLRSDDTAVYYCARWYGDYGLDYWGQGTLVTVSS |
| SEQ ID 87 | EVQLVQSGAEVKKPGASVKVSCKASGYTFTSYAMHWVRQAPGQRLAWMGWINAGNGNTKYSEKFEGRVTI<br>TRDTSASTAYMELSSLRSEDTAVYYCARVAKYYYESGGYRASNWFDPWGQGTLVTVSS |
| SEQ ID 88 | QVQLQESGPGLVKPSQTLSLTCAISGDSVSSNSAAWNWIRQSPSRGLEWLGRTYYRSKWYNDYAVSVKSRITIN<br>PDTSKNQFSLQLNSVTPEDTAVYYCARAPPPTVGWYAPVFDYWGQGTLVTVSS |
| SEQ ID 89 | QLQLQESGGGLVQPGGSLRLSCSASGISFRDYWMHWIRQTPGKGLVWVSRINPDGSSTSYADSVKGRFTISRD<br>NSKNTLYLQMNSLRAEDTAVYYCAKVTGRRVGAHDYWGQGTLVTVSS |
| SEQ ID 90 | QVQLVQSGAEVKKPGASVKVSCKASGYTFTGYYMHWVRQAPGQGLEWMGWINPNSGGTNYAQKFQGRVT<br>MTRDTSISTAYMELSRLRSDDTAVYYCAFAQPGAETLNFDLWGRGTLVTVSS |
| SEQ ID 91 | QVQLQQSGPGLVKPSQTLSLTCAISGDSVSSKSAAWNWIRQSPSRGLEWLGRTYYRSKWNNDYALSVKSRITI<br>NPDTSKNQFSLQLKSVTPEDTALYYCVRQVAGGMDVWGQGTTVTVSS |
| SEQ ID 92 | QVQLVQSGGGLVQPGRSLRLSCTASGFTFGDYAMSWFRQAPGKGLEWVSAISGSGGSTYYADSVKGRFTISR<br>DNSKNTLYLQMNSLRAEDTAVYYCAKGSVYSGSYYMLIDYWGQGTLVTVSS |
| SEQ ID 93 | QVQLQQSGPGLVRPSQTLSLTCVISGDSVSSGSAAWNWIRQSPSRGLEWLGRTYYRAKWYNEYAGSVKSRITIS<br>PDTSKNQFSLQLNSVTPEDTAVYFCTRQDKDNTRYSGLGVWGQGTTVTVSS |
| SEQ ID 94 | EVQLVETGGGLVQPGGSLRLSCAASEFTLRNYGVSWVRQAPGKGLEWVSGMSGSGYSTYYADSVKGRFTISR<br>DSSKNTLFLQMDSLRAEDTAIYYCARGPRMWSSGIDAFDIWGHGTMVTVSS |
| SEQ ID 95 | QVQLQQWGAGLLKPSETLSLTCAVYGGSVSGYYWSWIRQPPGKGLEWMGEIHHSGSTNYNPSLKSRVTISLDT<br>PKNQFSLKLSSVTAADTAVYYCARRDWAGKRVWGQGTLVTVSS |
| SEQ ID 96 | QVQLQQSGPGLLKPSQTLSLTCAISGDSVSSNTATWNWIRQSPSRGLEWLGRTYYRSKWYKDNALSVKSRITIN<br>PDTSKNQFSLQLNSVTPEDTAVYYCAGGRAGIAAFDIWGQGTTVTVSS |
| SEQ ID 97 | QVQLVQSGGGLIQPGGSLRLSCAASGFTVSSNYMSWVRQAPGKGLEWVSLIYSDGRTNYADSVKGRFTISRDN<br>SKNTLYLQMNSLRAEDTAVYYCAKGALQGEWRRFDYWGQGTLVTVSS |
| SEQ ID 98 | QVQLQQSGPGLVKPSQTLSLTCAISGDSVSSNSAAWNWIRQSPSRGLEWLGRTYYRSKWYNDYAVSVKSRITI<br>NPDTSKNQFSLQLNSVTPEDTAVYYCTRTNQGYGGNSGVFDYWGQGTLVTVSS |
| SEQ ID 99 | QVQLQQSGPGLVKPSQTLSLTCAISGDSVGNSAAWNWIRQSPSRGLEWLGRTYYRSKWYNDYAVSVKSRITI<br>NPDTSKNQFSLQLNSVTPEDTAVYYCARIVGGAVDCWGQGTLVTVSS |
| SEQ ID 100 | EVQLVQSGAEVKKPGASVKVSCKASGYTFTSYAMHWVRQAPGQRLEWMGWINAGNGNTKYSQKFQGRVTI<br>TRDTSASTAYMELSSLRSEDTAVYYCARVRVGATTVYDSWFDPWGQGTLVTVSS |

TABLE 2-continued

VH Amino Acid Sequences

| SEQ ID | VH Amino Acid Sequence |
|---|---|
| SEQ ID 101 | QVQLVQSGGGLVQPGGSLRLSCAASGFTFSSYAMSWVRQAPGKGLEWVSAISGSGGSTYYADSVKGRFTISRD<br>NSKNTLYLQMNSLRAEDTAVYYCAKDGGSSPYYDSSGLLPWYFDLWGRGTLVTVSS |
| SEQ ID 102 | QVQLQESGGGLVQPGGSLRLSCAASGFTFSSYAMHWVRQAPGKGLEYVSAISSNGGSTYYANSVKGRFTISRD<br>NSKNTLYLQMGSLRAEDMAVYYCARAKFWTYYFDYWGQGTLVTVSS |
| SEQ ID 103 | QVQLQQWGAGLLKPSETLSLTCAVYGGSFSGYYWSWIRQPPGKGLEWIGEINHSGSTNYNPSLKSRVTISVDTS<br>KNQFSLKLSSVTAADTAVYYCARGGGSGSYYKRFFDYWGQGTLVTVSS |
| SEQ ID 104 | EVQLVQSGAEVRKPGASVKVSCKASGYTFTSYAISWVRQAPGQGLEWMGWISAYDGNTNYAQKLQGRVTM<br>TTDTSTSTAYMEVRSLRSDDTAVYYCARDGTVRRVVGATTPGNFDYRGQGTLVTVSS |
| SEQ ID 105 | EVQLVQSGGGVVQPGRSLRLSCAASGFTFSSYGMHWVRQAPGKGLEWVAVIWYDGSNKYYADSVKGRFTIS<br>RDNSKNTLYLQMNSLRAEDTAVYYCARDLNRGYCSGGSCFGYWGQGTLVTVSS |
| SEQ ID 106 | QVQLQESGGGLVQPGGSLRLSCAASGFTFSSYAMSWVRQAPGKGLEWVSYISSSGTTIYYADSVKGRFTVSRD<br>NAKNSLYLQMNSLRAEDTAVYYCARDYSSSGECFDYWGQGTLVTVSS |
| SEQ ID 107 | EVQLVQSGGGVVQPGRSLRLSCAASGFTFSSYGMHWVRQAPGKGLEWVAVIWYDGSNKYYADSVKGRFTIS<br>RDNSKNTLYLQMNSLRAEDTAVYYCARDQAAMVGYFDYWGQGTLVTVSS |
| SEQ ID 108 | QVTLKESGGGVVQPGRSLRLSCAASGF1FSNYAIHWVRQAPGKGLEWVAVISYDGSNKYYADSVKGRFTISRDN<br>SKNTLYLQMNSLRAEDTAVYYCARTFAGYSSKLGYFDLWGRGTLVTVSS |

A VH amino acid sequence of the disclosure may be encoded by a polynucleotide shown in Table 3 below.

TABLE 3

VH DNA Sequences

| SEQ ID | VH DNA Sequence |
|---|---|
| SEQ ID 109 | GAAGTGCAGCTGGTGCAGTCTGGGGCTGAGGTGAAGAAGCCTGGGGCCTCAGTGAAGG<br>TTTCCTGCAAGGCTTCTGGATACACCTTCACTAGCTATGCTATGCATTGGGTGCGCCAGG<br>CCCCCGGACAAAGGCTTGAGTGGATGGGATGGATCAACGCTGGCAATGGTAACACAAA<br>ATATTCACAGAAGTTCCAGGGCAGAGTCACCATTACCAGGGACACATCCGCGAGCACAG<br>CCTACATGGAGCTGAGCAGCCTGAGATCTGAAGACACGGCTGTGTATTACTGTGCGAGA<br>GGCTCCTTGTCCCGAAGTGGCTGGTACGCCGGACTCTTTGACTACTGGGGCCAGGGAAC<br>CCTGGTCACCGTCTCCTCA |
| SEQ ID 110 | CAGATCACCTTGAAGGAGTCTGGGGGAGGCGTGGTCCAGCCTGGGAGGTCCCTGAGACT<br>CTCCTGTGCAGCCTCTGGATTCACCTTCAGTAGTTATAGCATGAACTGGGTCCGCCAGGC<br>TCCAGGCAAGGGGCTGCAGTGGGTGGCAATTATATCAGATGATGGAAGTAAGAGTTACT<br>ACGCAGACTCCGTGCAGGGCCGATTCACCATCTCCAGAGACAATTCGAGGAACACAGTA<br>TTTCTGCAAATGAACAGCCTGAGAGCTGAGGACACGGCTATGTATTACTGTGCGAGAGA<br>CAGGGGAACTAAATGGAACCAATTGAATGATGTTTTTGATATGTGGGGCCAAGGGACAA<br>TGGTCACCGTCTCTTCA |
| SEQ ID 111 | GAAGTGCAGCTGGTGCAGTCTGGGGCTGAGGTGAAGAAGCCTGGGGCCTCAGTGAAGG<br>TTTCCTGCAAGGCATCTGGATACACCTTCACCAGCTACTATATGCACTGGGTGCGACAGG<br>CCCCTGGACAAGGGCTTGAGTGGATGGGAATAATCAACCCTAGTGGTGGTAGCACAAGC<br>TACGCACAGAAGTTCCAGGGCAGAGTCACCATGACCAGGGACACGTCCACGAGCACAG<br>TCTACATGGAGCTGAGCAGCCTGAGATCTGAGGACACGGCCGTGTATTACTGTGCGAGA<br>GGCCGAGGGTATAGCAGCAGTCGGCTCTACTACTTTGACTACTGGGGCCAGGGAACCCT<br>GGTCACCGTCTCCTCA |
| SEQ ID 112 | CAGGTCACCTTGAAGGAGTCTGGGGGAGGCTTGGTCCAGCCTGGAGGGTCCCTGAGACT<br>CTCCTGTGAAGCCTCTGGATTCACCTTCAGTGACCCCTACATGGACTGGGTCCGCCAGGC<br>TCCAGGCAAGGGGCTGGAGTGGGTTGGCCGAATTACAAATAAGCGTACCGGTTACGCCA<br>CAACATATGCCGCGTCTGTGAAGGACAGATTCACCATCTCAAGAGATGATTCAAGGAAG<br>TCAGTATATCTGCAAATGAACAGCCTGAAGACCGAGGACACGGCCGTATATTATTGTGC<br>AACAGATGTCAGTGGGTCCTTCGCGGCCTACGGGGGCCAGGGCACCCTGGTCACCGTCT<br>CCTCA |
| SEQ ID 113 | GAGGTCCAGCTGGTACAGTCTGGGGGAGGCGTGGTCCAGCCTGGGAGGTCCCTGAGACT<br>CTCCTGTGCAGCGTCTGGATTCACCTTCAGTAGCTATGCTATGCATTGGGTGCGCCAGG<br>CCCCCGGACAAAGGCTTGAGTGGATGGGATGGATCAACGCTGGCAATGGTAACACAAAA<br>TATTCACAGAAGTTCCAGGGCAGAGTCACCATTACCAGGGACACATCCGCGAGCACAGC<br>CTACATGGAGCTGAGCAGCCTGAGATCTGAAGACACGGCTGTGTATTACTGTGCGGGAG<br>AGGGCGGAGCAGTGGCTGGTACTGTCTACTGGGGCCAGGGAACCCTGGTCACCGTCTCC<br>TCA |

TABLE 3-continued

VH DNA Sequences

| SEQ ID | VH DNA Sequence |
|---|---|
| SEQ ID 114 | CAGGTCCAGCTGGTGCAGTCTGGGGGAGGCTTGGTAAAGCCTGGGGGGTCCCTTAGACTCTCCTGTGCAGCCTCTGGATTCACTTTCAGTAACGCCTGGATGAGCTGGGTCCGCCAGGCTCCAGGGAAGGGGCTGGAGTGGGTTGGCCGTATTAAAAGCAAAACTGATGGTGGGACAACAGACTACGCTGCACCCGTGAAAGGCAGATTCACCATCTCAAGAGATGATTCAAAAAACACGCTGTATCTGCAAATGAACAGCCTGAAAACCGAGGACACAGCCGTGTATTACTGTACCACAGACGAGTATTTCTACTGGGGCCAGGGAACCCTGGTCACCGTCTCCTCA |
| SEQ ID 115 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTACTACTGGAGCTGGATCCGCCAGCCCCCAGGGAAGGGGCTGGAGTGGATTGGGGAAATCAATCATAGTGGAAGCACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGAGTAAATCCGGGGAGTTATACGAGGGAGGTGAGCAACTTTGACTACTGGGGCCAGGGAACCCTGGTGACCGTCTCCTCA |
| SEQ ID 116 | CAGGTACAGCTGCAGCAGTCAGGTCCAGAATTGGTGAAGCCCTCGCAGACCCTCACACTCACCTGTGGCATCTCCGGGGACAGTGTCTCTAGCAACAGTGTTACTTGGAACTGGGTCAGGCAGTCCCCATCGAGAGGCCTTGAGTGGCTGGGAAGGACTTACTACCGGTCCCAGTGGTATTATAATTATGCGGTGTCTGTGAAAAGTCGAATAACCATCAGCCCAGACACATCCAAGAACCAGTTCTCCCTGCAGTTGAATTCTGTGACTCCCGAGGACACGGCTGTCTATTACTGTGCAACCAGGGGACATAACTACGGTGTAGATTACTGGGGCCGGGGACCACGGTCACCGTCTCCTCA |
| SEQ ID 117 | CAGGTGCAGCTGGTGCAGTCTGGGGGAGGCTTGGTAAAGCCTGGGGGGTCCCTTAGACTCTCCTGTGCAGCCTCTGGATTCACTTTCAGTAACGCCTGGATGAGCTGGGTCCGCCAGGCTCCAGGGAAGGGGCTGGAGTGGGTTTGCCGTATTAAAAGCAAAACTGATGGTGAGACAACAGACTACGCTGCACCCGTGAAAGGCAGATTCACCATCTCAAGAGATGATTCAAAAAACACGCTGTATCTGCAAATGAACAGCCTGAAAACTGAGGACACAGCCGTGTATCACTGTACCACAGGGGTGGGATGGTCGCCCTTCCAATACTGGGCCAGGGCACCCTGGTCACCGTCTCCTCA |
| SEQ ID 118 | GAGGTCCAGCTGGTACAGTCTGGGGGAGGCTTGGTACAGCCAGGGCGGTCCCTGAGACTCTCCTGTACAGCTTCTGGATTCACCTTTGGTGATTATGCTATGAGCTGGTTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCTGCAAATGAACAGCCTGAAAACCGAGGACACAGCCGTGTATTACTGTACTAGAGACGACAAAATAGCAGCAGCTGGATTCACATACTGGTACTTCGATCTCTGGGGCCGTGGCACCCTGGTCACCGTCTCCTCA |
| SEQ ID 119 | CAGGTGCAGCTGGTGCAGTCTGGGGCTGAGGTGAAGAAGCCTGGGGCCTCAGTGAAGGTCTCCTGCAAGGCTTCTGGATACACCTTCGCCGCCTATTATTTACACTGGGTGCGACAGGCCCCTGGACAAGGCCTTGAGTGGATGGGGCGGATCAGCCCTGGTAACGGTGTCACAAGTTATGCACAGAAATTTCAGGGCAGAGTCACCATGACCGGGGACACGTCCATTAACACAGTCTACATGCAACTGAACAATTTGATTTCTGGCGACACGGCCGTATATTACTGTGCGAGAGAGGCTGCCGACGACCCGTTTGACCATTGGGGCCAGGGAGCCCTGGTCACCGTCTCCTCA |
| SEQ ID 120 | GAAGTGCAGCTGGTGCAGTCTGGGGGAGGCGTGGTCCAGCCTGGGAGGTCCCTGACACTCTCCTGTGCAGCCTCTGGATTCACCTTCAGTTCCCATCTTATGCACTGGGTCCGCCAGGCTCCAGGCAAGGGGCTGGAGTGGGTGGCAGTTATATCATATGATGGAACTAGTAAATATTACGGAGACTCCGTGAAGGGCCGCTTCACCATCTCCAGAGACAATTCCAAGAACACGTTGTATCTGCAAATGAACAGCCTGCGAGCTGAAGACACGGCTATATATTACTGTGCGAAAGCAGATTATAAATATGACTGGGGCCAGGGAACCCTGGTCACCGTCTCCTCA |
| SEQ ID 121 | GAGGTGCAGCTGGTGCAGTCTGGGGGAGGCTTGGTCAAGCCTGGAGGGTCCCTGAGACTCTCCTGTACAGCTTCTGGATTCACCTTTGGTGATTATGCTATGAGCTGGGTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCTGCAAATGAACAGCCTGAAAACCGAGGACACAGCCGTGTATTACTGTACTACTCATAGACGCCCAATTTACGATATTTTGACTGGTTTTGACTACTGGGGCCAGGGAACCCTGGTCACCGTCTCCTCA |
| SEQ ID 122 | CAGCTGCAGCTGCAGGAGTCCGGGGGAGGCTTGGTACAGCCAGGGCGGTCCCTGAGACTCTCCTGTACAGCTTCTGGATTCACCTTTGGTGATTATGCTATGAGCTGGGTCCGCCAGGCTCCAGGGAAGGGGCTGGAGTGGGTAGGTTTCATTAGAAGCAAAGCTTATGGTGGGACAACAGAATACGCCGCGTCTGTGAAAGGCAGATTCACCATCTCAAGAGATGATTCCAAAAGCATCGCCTATCTGCAAATGAACAGCCTGAAAACCGAGGACACAGCCGTGTATTACTGTACTAGAGAGGATACTATGGTTCGGGGAGTTATTCCCTGGGGCCAGGGAACCCTGGTCACCGTCTCCTCA |
| SEQ ID 123 | CAGCTGCAGCTGCAGGAGTCCGGCTCAGGACTGGTGAAGCCTTCACAGACCCTGTCCCTCACCTGCGCTGTCTCTGGTGGCTCCATCAGCAGTGGTTACTCCTGGAGCTGGATCCGGCAGCCACCAGGGAAGGGCCTGGAGTGGATTGGGTACATCTATCATAGTGGGAGCACCTACTACAACCCGTCCCTCAAGAGTCGAGTCACCATATCAGTAGACAGGTCCAAGAACCAGTTCTCCCTGAAGCTGAGCTCTGTGACCGCCGCGGACACGGCTGTGTATTACTGTGCGAGAGATCGGCGTTACTATGATAGTAGTGGTTATTATCCCGCCTACTACTTTGACTACTGGGGCCAGGGAACCCTGGTCACCGTCTCCTCA |

TABLE 3-continued

VH DNA Sequences

| SEQ ID | VH DNA Sequence |
|---|---|
| SEQ ID 124 | GAAGTGCAGCTGGTGCAGTCTGGGGGAGGCCTGGTCAAGCCTGGGGGGTCCCTGAGACTCTCCTGTGCAGCCTCTGGATTCACCTTCAGTAGCTATAGCATGAACTGGGTCCGCCAGGCTCCAGGGAAGGGGCTGGAGTGGGTTTCATACATTAGTAGTAGTGGTAGTTACACAAACTACGCAGACTCTGTGAAGGGCCGATTCACCATCTCCAGAGACAACGCCAAGAACTCACTGTATCTGCAAATAAACAGCCTGAGAGCCGAGGACACGGCCATTTATTACTGTGCGAGAGACGGGGGCTATGATAGTAGTGGTTTTCACTTTGACTACTGGGGCCAGGGAACCCTGGTCACCGTCTCCTCA |
| SEQ ID 125 | CAGGTACAGCTGCAGCAGTCAGGTCCAGGACTGGTGAAGCCCTCGCAGACCCTCTCACTCACCTGTGCCATCTCCGGGGACAGTGTCTAACAACAGGGCTGCTTGGAACTGGATCAGGCAGTCGCCATCGAGAGGCCTTGAGTGGCTGGGAAGGACATACTACAGGTCCAAGTGGTATAATGAATATGCAGTCTCTGTGAAAAGTCGAATAACCATCAACCCAGACACATCCAAGAACCAGTTCTCCCTGCAGCTGAACTCTATGACTCCCGAGGACTCGGCTGTGTATTACTGTGCAATTTTGCCTAGTAGTGGTTATCTACAGGACCACCACTACTACGGTATGGACGTCTGGGGCCAAGGGACCACGGTCACCGTCTCCTCA |
| SEQ ID 126 | GAGGTGCAGCTGGTGCAGTCTGGAGCTGAGGTGAAGAAGCCTGGGGCCTCAGTGAAGGTCTCCTGCAAGGCTTCTGGTTACACCTTTACCAGCTACGGTATCAGCTGGGTGCGACAGGCCCCTGGACAAGGGCTTGAGTGGATGGGATGGATCAGCGCTTACAATGGTAACACAAACTATGCACAGAAGCTCCAGGGCAGAGTCACCATGACCACAGACACATCCACGAGCACAGCCTACATGGAGCTGAGCAGCCTGAGATCTGAGGACACGGCCGTGTATTACTGTGCGAGAGCCGCGGTGGGGGATGGATACAGCTATGGTCGGCTCGATTGGGGCCAGGGAACCCTGGTCACCGTCTCCTCA |
| SEQ ID 127 | GAGGTCCAGCTGGTACAGTCTGGAGCAGAGGTGAAAAAGCCCGGGGAGTCTCTGAAGATCTCCTGTAAGGGTTCTGGATACAGCTTTACCAGCTACTGGATCGGCTGGGTGCGCCAGATGCCCGGGAAAGGCCTGGAGTGGATGGGGATCATCTATCCTGGTGACTCTGATACCAGATACAGCCCGTCCTTCCAAGGCCAGGTCACCATCTCAGCCGACAAGTCCATCAGCACCGCCTACCTGCAGTGGAGCAGCCTGAAGGCCTCGGACACCGCCATGTATTACTGTGCGAGACTCCCCTCGTATTACTATGATAGTAGTGGTTACTTTACCTGGTACTTCGATCTCTGGGGCCGTGGCACCCTGGTGACCGTCTCTTCA |
| SEQ ID 128 | GAGGTCCAGCTGGTACAGTCTGGAGCTGAGGTGAAGAAGCCTGGGGCCTCAGTGAAGGTCTCCTGCAAGGCTTCTGGTTACACCTTTACCAGCTATGGTATCAGCTGGGTGCGACAGGCCCCTGGACAAGGGCTTGAGTGGATGGGATGGATCATCCCTATCTTTGGTATAGCAAACTACGCACAGAAGTTCCAGGGCAGAGTCACGATTACCGCGGACAAATCCACGAGCACAGCCTACATGGAGCTGAGCAGCCTGAGATCTGAGGACACGGCCGTGTATTACTGTGCGAGAGAACTATACAACTATGGTTCAAAGGACTACTTTGACTACTGGGGCCAGGGAACCCTGGTCACCGTCTCCTCA |
| SEQ ID 129 | GAAGTGCAGCTGGTGCAGTCTGGAGCAGAGGTGAAAAAGCCCGGGGAGTCTCTGAAGATCTCCTGTAAGGGTTCTGGATACAGCTTTACCAGCTACTGGATCGGCTGGGTGCGCCAGATGCCCGGGAAAGGCCTGGAGTGGATGGGGATCATCTATCCTGGTGACTCTGATACCAGATACAGCCCGTCCTTCCAAGGCCAGGTCACCATCTCAGCCGACAAGTCCATCAGCACCGCCTACCTGCAGTGGAGCAGCCTGAAGGCCTCGGACACCGCCATGTATTACTGTGCGAGGGGCGGTACTTGGGATACAGCTATGGTTACGGGCTTTGACTACTGGGGCCAGGGAACCCTGGTCACCGTCTCCTCA |
| SEQ ID 130 | GAAGTGCAGCTGGTGCAGTCTGGAGCAGAGGTGAAAAAGCCCGGGGAGTCTCTGAAGATCTCCTGTAAGGGTTCTGGATACAGCTTTACCAGCTACTGGATCGCCTGGGTGCGCCAGATGCCCGGGAAAGGCCTGGAGTGGATGGGGTCATCTATCCTGGTGACTCTGATACCAGATACAGCCCGTCCTTCCAAGGCCAGGTCACCATCTCAGCCGACAAGTCCATCAATACCGCCTACCTGCAGTGGAGCAGCCTGAAGGCCTCGGACACCGCCATGTATTACTGTGCGAGACCCCATTACGATATTTTGACTGGTTCCCGGGCGCCCTTTGACTACTGGGGCCAGGGAACCCTGGTCACCGTCTCCTCA |
| SEQ ID 131 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTACTACTGGAGCTGGATCCGCCAGCCCCCAGGGAAGGGGCTGGAGTGGATTGGGAAATCAATCATAGTGGAAGCACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGAGCCCGAGTGGAATCCAAGGATGGGTACTTTGACTACTGGGGCCAGGGAACCCTGGTCACCGTCTCCTCA |
| SEQ ID 132 | GAGGTGCAGCTGGTGGAGTCTGGGGGAGGCGTGGTCCAGCCTGGGAGGTCCCTGAGACTCTCCTGCAGCCTCTGGATTCACTTTCACTGATGCCTGGATGAACTGGGTCCGCCAGGCTCCAGGGAAGGGGCTGGAGTGGATTGGCCGTGTTAAAAACAAAGCTGATGGTGAGACAACGGACTACGCTGCACCCGTCAAAGGCAGAATCACCATCTCAAGAGATGATGCAAAGAACACTCTGTATGTGCAAATGAACAGCCTGAAAACCGAGGACACAGCCGTGTATTATTGTACCGCTGACCTGCGACTTTCTACGTGGGATGCTTATGATTTCTGGGGCCAAGGGACAATGGTCACCGTCTCTTCA |

TABLE 3-continued

VH DNA Sequences

| SEQ ID | VH DNA Sequence |
|---|---|
| SEQ ID 133 | CAGATCACCTTGAAGGAGTCTGGGGGAGGCTTGGTCCAGCCTGGGGGGTCCCTAAGACT<br>CTCTTGTACAGTCTCAGGATTCACCTTTAGTAACAATTGGATGACCTGGGTCCGCCAGAC<br>TCCAGGGAAGGGGCTGGAGTGGGTGGCCAACATAAAGCAAGATGGAACTGAGAAACAC<br>TATGTGGACTCTGTGAAGGGCCGATTCACCATCTCCAGAGACAACGCCGAGAACTCACT<br>GTATCTGCAGATGAACAGCCTGAGAGGTGAGGACACGGCCGTGTATTATTGTGCGAGAA<br>ACAGTCAACGTTCGTTTGACTACTGGGGCCAGGGCACCCTGGTGACCGTCTCCTCA |
| SEQ ID 134 | CAGGTCACCTTGAAGGAGTCTGGGGGAGGCGTGGTCCAGCCTGGGAGGTCCCTGAGACT<br>CTCCTGTGCAGCCTCTGGATTCACCTTCAGTAGCTATGGCATGCACTGGGTCCGCCAGGC<br>TCCAGGCAAGGGGCTGGAGTGGGTGGCAGTTATATCATATGATGGAAGTAATAAATACT<br>ATGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAAAGA<br>TTTAGGGGATCCCCGGGGTGGTATTTTGAACTACTGGGGCCAGGGCACCCTGGTCACCG<br>TCTCCTCA |
| SEQ ID 135 | GAGGTGCAGCTGGTGGAGTCTGGGGGAGGCGTGGTCCAGCCTGGGAGGTCCCTGAGACT<br>CTCCTGTGCAGCCTCTGGATTCACCTTCAGTAGCTATGCTATGCACTGGGTCCGCCAGGC<br>TCCAGGCAAGGGGCTGGAGTGGGTGGCAGTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCCCGGTC<br>GAGCCCCTGGGGGAGTTATCGTTATACCAGGGGGCTTTTGATATCTGGGGCCAAGGGA<br>CAATGGTCACCGTCTCTTCA |
| SEQ ID 136 | CAGATCACCTTGAAGGAGTCTGGGGGAGGCTTGGTACAGCCTGGCAGGTCCCTGAGACT<br>CTCCTGTGCAGCCTCTGGATTCACCTTTGATGATTATGCCATGCACTGGGTCCGCCAAGC<br>TCCAGGGAAGGGGCTGGAGTGGGTCTCAGCTATTAGTGGTAGTGGTGGTAGCACATACT<br>ACGCAGACTCCGTGAAGGGCCGGTTCACCATCTCCAGAGACAATTCCAAGAACACGCTG<br>TATCTGCAAATGAACAGCCTGAGAGCCGAGGACACGGCGTATATTACTGTGCGAAAGA<br>TAACGATTTTTGGAGTGGGAAAGTCTTTGACTACTGGGGCCAGGGCACCCTGGTCACCG<br>TCTCCTCA |
| SEQ ID 137 | GAAGTGCAGCTGGTGCAGTCTGGGGGAGGCTTGGTACAGCCTGGGGGGTCCCTGAGACT<br>CTCCTGTGCAGCCTCTGGATTCACCTTCAGTAGTTATAGCATGAACTGGGTCCGCCAGGC<br>TCCAGGGAAGGGGCTGGAGTGGGTTTCATACATCAGTAGTACTAGTAGTACCATATACT<br>ACGCAGACTCCGTGAAGGGCCGATTCACCATCTCCAGAGACAATTCCAAGAATATGCTG<br>TTTCTACAAATGAACAGCCTGAGAGCTGAGGACACGGCTGTGTATTACTGTGCGAAAGA<br>AGGGGGCAGTGGCTGGCGCCACTACTTTGACTACTGGGGCCAGGGAACCCTGGTCACCG<br>TCTCCTCA |
| SEQ ID 138 | CAGGTCACCTTGAAGGAGTCTGGGGGAGGCGTGGTCCAGCCTGGGAGGTCCCTGAGACT<br>GTCCTGTGCAGCCTCTGGATTCACCTTCAGCAGCTATGCTATGCACTGGGTCCGCCAGGC<br>TCCAGGCAAGGGGCTGGAGTGGGTGGCAGTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAGAGA<br>TTATTGTAGTAGTACCAGCTGCCAGAACTGGTTCGACCCCTGGGGCCAGGGCACCCTGG<br>TCACCGTCTCCTCA |
| SEQ ID 139 | CAGGTCCAGCTGGTGCAGTCTGGGGGAGGCTTGGTACAGCCTGGGGGGTCCCTGAGACT<br>CTCCTGTGCAGCCTCTGGATTCACCTTTAGCAACTATGTCATGAGCTGGGTCCGCCAGGC<br>TCCAGGGAAGGGGCTGGAGTGGGTCTCAGCTATTAGTGGTATTGGTGATACTACATACT<br>ACGCGGACTCCGTGAAGGGCCGATTCACCATCTCCAGAGACAACGCCAAGAACACGCTG<br>TATCTGCAAATGAACAGTCTGAGAGCCGAGGACACGGCTGTGTATTACTGTGCAAGAGG<br>GCGCGTGGCGGGGATGCTTTTGATATCTGGGGCCAAGGGACAATGGTGACCGTCTCTT<br>CA |
| SEQ ID 140 | CAGCTGCAGCTGCAGGAGTCGGGGGGAGGCTTGGTACAGCCTGGGGGGTCCCTGAGACT<br>CTCCTGTGCAGCCTCTGGATTCACCTTTAGCAGCTATGCCATGAGCTGGGTCCGCCAGGC<br>TCCAGGGAAGGGGCTGGAGTGGGTCTCAGCTATTAGTGGTAGTGGTGGTAGCACATACT<br>ACGCAGACTCCGTGAAGGGCCGGTTCACCATCTCCAGAGACAATTCCAAGAACACGCTG<br>TATCTGCAAATGAACAGCCTGAGAGCCGAGGACACGGCCGTATATTACTGTGCGAAAGA<br>TCAAGGGGCAGCAGCTGGTACCCTGGGGTACTTTGACTACTGGGGCCAGGGAACCCTGG<br>TGACCGTCTCCTCA |
| SEQ ID 141 | CAGGTGCAGCTGGTGCAGTCTGGGGCTGAGGTGAAGAAGCCTGGGGCCTCAGTGAAGGT<br>CTCCTGCAAGGCTTCTGGATACACCTTCACCAGTTATGATATCAACTGGGTGCGACAGGC<br>CACTGGACAAGGGCTTGAGTGGATGGGATGGATGAACCCTAACAGTGGTAACACAGGCT<br>ATGCACAGAAGTTCCAGGGCAGAGTCACCATGACCAGGAACACCTCCATAAGCACAGCC<br>TACATGGAGCTGAGCAGCCTGAGATCTGAGGACACGGCCGTGTATTACTGTACGAGAGG<br>AATCTATGATAGTAGTGGTTCTTCCAATCCCTTTGACTCCTGGGGCCAGGGAACCCTGGT<br>GACCGTCTCCTCA |

TABLE 3-continued

VH DNA Sequences

| SEQ ID | VH DNA Sequence |
| --- | --- |
| SEQ ID 142 | GAGGTGCAGCTGGTGCAGTCTGGGGCTGAGGTGAAGAAGCCTGGGGCCTCAGTGAAGA TTTCCTGCGAGGCTTCTGGATACACCTTCACTGATTATGCTATACATTGGGTGCGCCAGG CCCCCGGACAAAGACTTGAGTGGATGGGATGGATCAACGCTGGCGATGGTGGCACAAA AAGTTCACGGGAGTTCCAGGGCAGAGTCACCATTACCAGGGACACATCCGCGACCACAG CCTACATGGAGGTGAGCAGTCTGAGATCTGAAGACACGGCTGTCTATTACTGTGCGAGA GGATATTGTAGTGGTGGTAGCTGCCCAGGAACGGATTTTGACTACTGGGGCCAGGGAAC CCTGGTCACCGTCTCCTCA |
| SEQ ID 143 | CAGGTGCAGCTGGTGCAGTCTGGGGCTGAGGTGAAGAAGCCTGGGGCCTCAGTGAAGGT TTCCTGCAAGGCATCTGGATACACCTTCACCAGCTACTATATGCACTGGGTGCGACAGGC CCCTGGACAAGGGCTTGAGTGGATGGGAATAATCAACCCTAGTGGTGGTAGCACAAGCT ACGCACAGAAGTTCCAGGGCAGAGTCACCATGACCAGGGACACGTCCACGAGCACAGT CTACATGGAGCTGAGCAGCCTGAGATCTGAGGACACGGCCGTGTATTACTGTGCGAGAG ATGGTGTAGGAGGGAGAGATGGCTACAATTTTGACTACTGGGGCCAGGGAACCCTGGTC ACCGTCTCCTCA |
| SEQ ID 144 | GAAGTGCAGCTGGTGCAGTCTGGGGGAGGCTTGGTCCAGCCTGGGGGGTCCCTGAGACT CTCCTGTGCAGCCTCTGGATTCACCGTCAGTAGCAACTACATGAGCTGGGTCCGCCAGGC TCCAGGGAAGGGGCTGGAGTGGGTCTCAGTTATTTATAGCGGTGGTAGCACATACTACG CAGACTCCGTGAAGGGCCGATTCACCATCTCCAGAGACAATTCCAAGAACACGCTGTAT CTTCAAATGAACAGCCTGAGAGCTGAGGACACGGCTGTGTATTACTGTGCGAGAGCCCC CCTAGCAGCAGATGGCTACTTTGACTACTGGGGCCAGGGAACCCTGGTCACCGTCTCCTC A |
| SEQ ID 145 | GAGGTCCAGCTGGTGCAGTCTGGGGCTGAGGTGAAGAAGCCTGGGTCCTCGGTGAAGGT CTCCTGCAAGGCTTCTGGAGGCACCTTCAGCAGCTATGCTATCAGCTGGGTGCGACAGG CCCCTGGACAAGGGCTTGAGTGGATGGGAGGGATCATCCCTATCTTTGGTACAGCAAAC TACGCACAGAAGTTCCAGGGCAGAGTCACGATTACCGCGGACGAATCCACGAGCACAG CCTACATGGAGCTGAGCAGCCTGAGATCTGAGGACACGGCCGTGTATTACTGTGCGAGA GCCCGGGGGCTACAGTACCTAATCTGGTACTTCGATCTCTGGGGCCGTGGCACCCTGGTG ACCGTCTCCTCA |
| SEQ ID 146 | CAGGTCCAGCTGGTACAGTCTGGGGCTGAGGTGAAGAAGCCTGGGGCCTCAGTGAAGGT TTCCTGCAAGGCATCTGGATACACCTTCACCAGCTACTATATGCACTGGGTGCGACAGGC CCCTGGACAAGGGCTTGAGTGGATGGGAATAATCAACCCTAGTGGTGGTAGCACAAGCT ACGCACAGAAGTTCCAGGGCAGAGTCACCATGACCAGGGACACGTCCACGAGCACAGT CTACATGGAGCTGAGCAGCCTGAGATCTGAGGACACGGCCGTGTATTACTGTGCGAGCC CGGGTATGGTTCGGGGAGTTATTACTGCCCCGCTTGACTACTGGGGCCAGGGCACCCTG GTCACCGTCTCCTCA |
| SEQ ID 147 | GAGGTCCAGCTGGTACAGTCTGGGGGAGGCCTGGTCAAGCCTGGGGGGTCCCTGAGACT CTCCTGTGCAGCCTCTGGATTCACCTTCAGCAGCTATGCTATCAGCTGGGTGCGACAGGC CCCTGGACAAGGGCTTGAGTGGATGGGAGGGATCATCCCTATGTATGGTACAGCAAACT ACGCACAGAAGTTCCAGGGCAGAGTCACGATTACCGCGGACGAATCCACGAGCACAGC CTACATGGAACTGAGCAGCCTGAGATCTGAGGACACGGCCCTCTATTACTGTGCGAGAG AAGCTAAGTGGGGAATGTACTACTTTGACTACTGGGGCCAGGGCACCCTGGTCACCGTC TCCTCA |
| SEQ ID 148 | GAGGTGCAGCTGGTGGAGTCCGGGGGAGGCGTGGTCCAGCCTGGGGAGGTCCCTGAGACT CTCCTGTGCAGCCTCTGGATTCACCTTCAGTAGCTATGCTATACACTGGGTCCGCCAGGC TCCAGGCAAGGGGCTGGAGTGGGTGGCAATTATATCAGATGATGGAAGTAAGAGTTACT ACGCAGACTCCGTGCAGGGCCGATTCACCATCTCCAGAGACAATTCGAGGAACACAGTA TATCTGCAAATGAACAGCCTGAGAGCTGAGGACACGGCTATGTATTACTGTGCGAGAGA CAGGGGAACTAAATGGAACCAATTGAATGATGTTTTTGATATGTGGGCCAAGGGACAA TGGTCACCGTCTCTTCA |
| SEQ ID 149 | CAGATGCAGCTGGTGCAATCTGGGGCTGAGGTGAAGAAGCCTGGGGCCTCAGTGAAGGT CTCCTGCACGGCTTCTGGATACACCTTCACCAGTTCTGATATCAACTGGGTGCGACAGGC CACTGGACAAGGGCTTGAGTGGATGGGATGGATGAACCCTAACAGTGGTAACACCGGCT ATGCAGAGAAGTTCCAGGGCAGGGTCACCATGACCAGCGACTCCTCCATAAGCACCGCC TACATGGAGTTGAGAAGCCTGACCACTGAGGACACGGCCGTATATTACTGTGCGAGAGG TGGGGGTGCGAGCTATACTGACTCCTGGGGCCAGGGCACCCTGGTCACCGTCTCCTCA |
| SEQ ID 150 | CAGGTCCAGCTGGTGCAGTCTGGGGGAGGCTTGGTACAGCCAGGGCGGTCCCTGAGACT CTCCTGTACAGCTTCTGGATTCACCTTTGGTGATTATGCTATGAGCTGGTTCCGCCAGGC TCCAGGGAAGGGGCTGGAGTGGGTAGGTTTCATTAGAAGCAAAGCTTATGGTGGGACAA CAGAATACGCCGCGTCTGTGAAAGGCAGATTCACCATCTCAAGAGATGATTCCAAAAGC ATCGCCTATCTGCAAATGAACAGCCTGAAAACCGAGGACACAGCCGTGTATTACTGTAC CGCTAAGGGGGCTACGTCGGATACAGCTATGGACCTTTTGGGGCTACTGGGGCCAGG GAACCCTGGTCACCGTCTCCTCA |

TABLE 3-continued

VH DNA Sequences

| SEQ ID | VH DNA Sequence |
|---|---|
| SEQ ID 151 | CAGGTGCAGCTGGTGCAGTCTGGGGGAGGCTTGGTACAGCCAGGGCGGTCCCTGAGACT<br>CTCCTGTACAGCTTCTGGATTCACCTTTGGTGATTATGCTATGAGCTGGTTCCGCCAGGC<br>TCCAGGGAAGGGGCTGGAGTGGGTAGGTTTCATTAGAAGCAAAGCTTATGGTGGGACAA<br>CAGAATACGCCGCGTCTGTGAAAGGCAGATTCACCATCTCAAGAGATGATTCCAAAAGC<br>ATCGCCTATCTGCAAATGAACAGCCTGAAAACCGAGGACACAGCCGTGTATTACTGTAC<br>TAGAGGGGGACTATGGTTCGGGGTTTCGGATTTAACTACTGGGGCCAGGGAACCCTGG<br>TCACCGTCTCCTCA |
| SEQ ID 152 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCTGTGACCGCCGCGGACACGGCTGTGTATTACTGTGCGAGAGCCC<br>GGCGGGCTATGATAGGGCCGCTTCCGCGACTTGTCGGGTACTTCGATCTCTGGGGCCGTG<br>GAACCCTGGTCACCGTCTCCTCA |
| SEQ ID 153 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCTGTGACCGCCGCGGACACGGCTGTGTATTACTGTGCGAGAGGCC<br>GCCCCGCCCCATCCTGGGTTAAAACCCGTAACTGGTTCGACCCCTGGGGCCAGGGAACC<br>CTGGTCACCGTCTCCTCA |
| SEQ ID 154 | CAGGTACAGCTGCAGCAGTCAGGTCCAGGACTGGTGAAGCCCTCGCAGACCCTCTCACT<br>CACCTGTGCCATCTCCGGGGACAGTGTCTCTAGCAACAGTGCTGCTTGGAACTGGATCA<br>GGCAGTCCCCATCGAGAGGCCTTGAGTGGCTGGGAAGGACATACTACAGGTCCAAGTGG<br>TATAATGATTATGCAGTATCTGTGAAAAGTCGAATAACCATCAACCCAGACACATCCAA<br>GAACCAGTTCTCCCTGCAGCTGAACTCTGTGACTCCCGAGGACACGGCTGTGTATTACTG<br>TGCAAGAGAGGCTAGCAGTGGCTGGAACTGGGGCCAGGGAACCCTGGTCACCGTCTCCT<br>CA |
| SEQ ID 155 | CAGGTGCAGCTGCAGGAGTCCGGTCCAGGACTGGTGAAGCCCTCGCAGACCCTCTCACT<br>CACCTGTGCCATCTCCGGGGACAGTGTCTCTAGCAACAATGCTGCTTGGAACTGGATCA<br>GGCAGTCCCCATCGAGAGGCCTTGAGTGGCTGGGAAGGACATTCTACAGGTCCAAGTGG<br>TATAATGACTATGCAGTTTCTGTGAAAAGTCGACTAACCGTCAACCCAGACACATCCAA<br>GAACCAGTTCTCCCTGCGGTTGAACTCTGTGAGTCCCGAGGACACGGCTGTGTATTACTG<br>TGCAAGAGGGGAAGATATACCAAGGGAGGGTACTTTGACGACTGGGGCCAGGGAACC<br>CTGGTGACCGTCTCCTCA |
| SEQ ID 156 | CAGGTCACCTTGAAGGAGTCTGGTCCTACGCTGGTGAAACCCACACAGACCCTCACGCT<br>GACCTGCACCTTCTCTGGGTTCTCACTCAGCACTAGTGGAGTGGGTGTGGGCTGGATCCG<br>TCAGCCCCCAGGAAAGGCCCTGGAGTGGCTTGCACTCATTTATTGGGATGATGATAAGC<br>GCTACAGCCCATCTCTGAAGAGCAGGCTCACCATCACCAAGGACACCTCCAAAAACCAG<br>GTGGTCCTTACAATGACCAACATGGACCCTGTGGACACAGCCACATATTACTGTGCACA<br>CAGATTGGATAGCAGTGGCCGTGGTGGTTACTTTGACTACTGGGGCCAGGGCACCCTGG<br>TCACCGTCTCCTCA |
| SEQ ID 157 | GAGGTGCAGCTGGTGGAGTCTGGGGGAGGCGTGGTCCAGCCTGGGAGGTCCCTGAGACT<br>CTCCTGTACAGCCTCTGGATTCACCTTCAGTAGCTATGGCATGCACTGGGTCCGCCAGGC<br>TCCAGGCAAGGGGCTGGAGTGGGTGGCAGTTATATCATATGATGGAAGTAATAAATACT<br>ATGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAAAGA<br>GTTGGTGGGTACCAGCTCTCCTTATTACTACTACTACGGTATGGACGTCTGGGGCCA<br>AGGGACAATGGTCACCGTCTCTTCA |
| SEQ ID 158 | CAGCTGCAGCTGCAGGAGTCGGGGGGAGGCTTGGTCCAGCCTGGGGGGTCCCTGAGACT<br>CTCCTGTGCAGCCTCTGGATTCACCGTCAGTAGCAACTACATGAGCTGGGTCCGCCAGGC<br>TCCAGGGAAGGGGCTGGAGTGGGTCTCAGTTATTTATAGCGGTGGTAGCACATACTACG<br>CAGACTCCGTGAAGGGCAGATTCACCATCTCCAGAGACAATTCCAAGAACACGCTGTAT<br>CTTCAAATGAACAGCCTGAGAGCCGAGGACACGGCTGTGTATTACTGTGCGAGAGACTA<br>TTACTATGGTTCGGGGAGTTCTCCCTGGGGCCAGGGAACCCTGGTCACCGTCTCCTCA |
| SEQ ID 159 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCTGTGACCGCCGCGGACACGGCTGTGTATTACTGTGCGAGAGGCC<br>GGCCATATTGTAGTAGTACCAGCTGCTACCCAGAGTGGTTCGACCCCTGGGGCCAGGGA<br>ACCCTGGTCACCGTCTCCTCA |

TABLE 3-continued

VH DNA Sequences

| SEQ ID | VH DNA Sequence |
|---|---|
| SEQ ID 160 | CAGGTCACCTTGAAGGAGTCTGGGGGAGGCGTGGTCCAGCCTGGGAGGTCCCTGAGACT CTCCTGTGCAGCCTCTGGATTCACCTTCAGTAGCTATGGCATGCACTGGGTCCGCCAGGC TCCAGGCAAGGGGCTGGAGTGGGTGGCAGTTATATCATATGATGGAAGTAATAAATACT ATGCAGACTCCGTGAAGGGCCGATTCACCATCTCCAGAGACAATTCCAAGAACACGCTG TATCTGCAAATGAACAGCCTGAGAGCTGAGGACACGGCTGTGTATTACTGTGCAAATT AAGGGGTATAGATTACTATGATAGTAGTGGTTACCAACGGGGGTTTGACTACTGGGGCC AGGGAACCCTGGTCACCGTCTCCTCA |
| SEQ ID 161 | CAGGTGCAGCTGCAGGAGTCCGGCCCAGGACTGGTGAAGCCTTCGGAGACCCTGTCCCT CACCTGCACTGTCTCTGGTGGCTCCATCAGTAGTTACTACTGGAGCTGGATCCGGCAGCC CCCAGGGAAGGGACTGGAGTGGATTGGCTATATCTATTACACTGGGAGCACCAACTACA ACCCCTCCCTCAAGAGCCGAGTCACCATATCAGTAGACACGTCCAAGAACCAGTTCTCC CTGAAGCTGAGCTCTGTGACCACTGCGGACACGGCCGTGTATTACTGTGCGAGAGGTGG GAGGGGGGATGGGGCCGCTTTTGACATCTGGGGCCAAGGGACAATGGTCACCGTCTCTT CA |
| SEQ ID 162 | CAGGTGCAGCTGGTGCAATCTGGGGGAGGCGTGGTCCAGCCTGGGAGGTCCCTGAGACT CTCCTGTGCAGCGTCTGGATTCACCTTCAGCAGCTCTGCCATGCACTGGGTCCGCCAGGC TCCAGGCAAGGGACTGGAGTGGGTGGCAATGATTTGGCATGATGAGAGTAAGAAATACT ATGCAGACTCCGTGAAGGGCCGATTCACTATCTCCAGAGACAATTCCAAGAACACGCTG TATCTGCAAATGAACAGCCTGAGAGCTGAGGACACGGCTGTGTATTACTGTGCGAGACC CCCCGACGGTGGTAACTCCGGTCGCTGGTACTTCGATCTCTGGGGCCGTGGCACCCTGGT CACCGTCTCCTCA |
| SEQ ID 163 | CAGATGCAGCTGGTGCAATCTGGGGGAGGCTTGGTACAGCCTGGGGGGTCCCTGAGACT CTCCTGTGCAGCCTCTGGATTCACCTTTAGCAGCTATGCCATGAGCTGGGTCCGCCAGGC TCCAGGGAAGGGGCTGGAGTGGGTCTCAGCTATTAGTGGTAGTGGTGGTAGCACATACT ACGCAGACTCCGTGAAGGGCCGGTTCACCATCTCCAGAGACAATTCCAAGAACACGCTG TATCTGCAAATGAACAGCCTGAGAGCCGAGGACACGGCCGTATATTACTGTGCGAAAGA CAAGAACGTCCGAAAACATGACTACGGTGACCACCCCTACGGGGGGTACTTTGACTACT GGGGCCAGGGCACCCTGGTGACCGTCTCCTCA |
| SEQ ID 164 | GAGGTCCAGCTGGTACAGTCTGGGGCTGAGGTGAAGAAGCCTGGGGCCTCAGTGAAGGT TTCCTGCAAGGCTTCTGGATACACCTTCACTAGCTATGCTATGCATTGGGTGCGCCAGGC CCCCGGACAAAGGCTTGAGTGGATGGGATGGATCAACGCTGGCAATGGTAACACAAAA TATTCACAGAAGTTCCAGGGCAGAGTCACCATTACCAGGGACACATCCGCGAGCACAGC CTACATGGAGCTGAGCAGCCTGAGATCTGAAGACACGGCTGTGTATTACTGTGCGAGAG TGGCGGGAGCTACTTCCCTATGGTACTGGGGCCAGGGCACCCTGGTCACCGTCTCCTCA |
| SEQ ID 165 | CAGGTACAGCTGCAGCAGTCAGGTCCAGGACTGGTGAAGCCCTCGCAGAGCCTCTCACT CACCTGTGCCATCTCCGGGGACAGTGTCTCTAGCAACAGTGCTGCTTGGAACTGGATCA GGCAGTCCCCATCGAGAGGCCTTGAGTGGCTGGGAAGGACATACTACAGGTCCAAGTGG TATAATGATTATGCAGTATCTGTGAAGAGTCGAATAACCATCAAACCAGACACATCCAA GAACCAGTTCTCCCTGCAGCTGAACTCTGTGACTCCCGAGGACACGGCTGTGTATTACTG TACAAGGCTAGCTAATTCCGACGGTGTGGACGTCTGGGGCCAAGGGACAATGGTCACCG TCTCCTCA |
| SEQ ID 166 | CAGGTACAGCTGCAGCAGTCAGGTCCAGGACTGGTGAAGCCCTCGCAGACCCTCTCACT CACCTGTGCCATCTCCGGGGACAGTGTCTCTAGCGACAGTGCTGTTTGGACCTGGATCAG GCAGTCCCCATCGAGAGGCCTTGAGTGGCTGGGAAGGACATACTACAAGTCGAAGTGGT ATAATGATTATGCAGCATCTGTGAAAAGTCGAATAACCATCAACCCAGACACATCCAAG AACCAGTTCTCCCTGCACCTGAACTCTGTGACTCCCGAGGACACGGCTGTGTATTACTGT GCAAGAGGTGTAACCCGGACCTTTGACTACTGGGGCCAGGGGACCACGGTCACCGTCTC CTCA |
| SEQ ID 167 | CAGCTGCAGCTGCAGGAGTCGGGTCCAGGACTGGTGAAGCCCTCGCAGACCCTCTCACT CACCTGTGCCATCTCCGGGGACAGTGTCTCTAGCAACAGTGCTGCTTGGAACTGGATCA GGCAGTCCCCATCGAGAGGCCTTGAGTGGCTGGGAAGGACATACTACAGGTCCAAGTGG TATAATGATTATGCAGTATCTGTGAAAAGTCGAATAACCATCAACCAGACACATCCAA GAACCAGTTCTCCCTGCAGCTGAACTCTGTGACTCCCGAGGACACGGCTGTGTATTACTG TGCAGAAGGCAATGGGCCGTTCGACCCCTGGGGCCAGGGAACCCTGGTGACCGTCTCCT CA |
| SEQ ID 168 | CAGATCACCTTGAAGGAGTCTGGGGGAGGCGTGGTCCAGCCTGGGAGGTCCCTGAGACT CTCCTGTGTAGCCTCTGGATTCACCTTCAGTACCTATCCCATGCACTGGGTCCGCCAGGC TCCAGGCAAGGGGCTGGAGTGGGTGGCAGTTATATCATATGATGGACGTAATGAATACT ACGCAGACTCCGTGAAGGGCCGATTCACCATCTCCAGAGACAATTCCAAAAACACGCTG TATCTGCAAATGAACAGTCTGCGAGCTGAAGACACGGCTGTCTATTATTGTGCGACTCG GGATACACCTTTGGTTGGGGTTTCGATATACTGGGGCCAGGGCACCCTGGTCACCGTCTC CTCA |

TABLE 3-continued

VH DNA Sequences

| SEQ ID | VH DNA Sequence |
| --- | --- |
| SEQ ID 169 | CAGATGCAGCTGGTGCAATCTGGGGGAGGCCTGGTCAAGGCTGGGGGGTCCCTGAGACT<br>CTCCTGTTCAGCCTCTGGATTCACCTTCAGTAGCTATGCTATGCACTGGGTCCGCCAGGC<br>TCCAGGGAAGGGACTGGAATATGTTTCAGCTATTAGTAGTAATGGGGGTAGCACATACT<br>ACGCAGACTCAGTGAAGGGCAGATTCACCATCTCCAGAGACAATTCCAAGAACACGCTG<br>TATCTTCAAATGAGCAGTCTGAGAGCTGAGGACACGGCTGTGTATTACTGTGTGAATCG<br>GGCGGGTTACGGTGACTACAGACACTTCCAGCACTGGGGCCAGGGCACCCTGGTCACCG<br>TCTCCTCA |
| SEQ ID 170 | GAGGTGCAGCTGGTGCAGTCTGGGGGAGGCGTGGTCCAGCCTGGGGGGTCCCTGAGACT<br>CTCCTGTGCAGCGTCTGGATTCACCTTCAGTAGCTATGGCATGCACTGGGTCCGCCAGGC<br>TCCAGGCAAGGGGCTGGAGTGGGTGGCATTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCCGAGGACACGGCCGTATATTACTGTGCGACAAC<br>AGGGGACCGCTTCCAAGAGTTTGACTACTGGGGCCAGGGAACCCTGGTCACCGTCTCCT<br>CA |
| SEQ ID 171 | CAGATGCAGCTGGTGCAGTCTGGGGGAGTCTTGCTTCAGCCAGGGCGGTCCCTGAGACT<br>CTCCTGTACAGCTTCTGGATTCACCTTTGCTGCTTATAATATCAACTGGTTCCGCCAGGGT<br>CCTGGGGGGGGCTGGAGTGGGTAGGTTTCATTAGAGCCAACGCTGATAGTGGGACAAC<br>AGAGTACGCCGCGTCTGTGAAAGGCAGATTCTTCATCTCAAGAGATGATTCCAGAAGCA<br>CCGCCTACCTGCAAATGACTAGCCTTAAAACCGAGGACACAGCCGTTTATTACTGTGCC<br>AGAGATGATCGGGGTCGGGAGATGACTTTGACTACTGGGGCCAGGGCACCCTGGTCAC<br>CGTCTCCTCA |
| SEQ ID 172 | CAGGTGCAGCTGGTGCAATCTGGGGGAGGCTTGGTACAGCCTGGGGGGTCCCTGAGACT<br>CTCCTGTGCAGCCTCTGGATTCACCTTTAGCAGCTATGGCATGACGTGGGTCCGCCAGGC<br>TCCAGGGAAGGGGCTGGAGTGGGTCTCAACTATTAGTGGTAATGGTGTTGGCACATACT<br>ACCCAGACTCCGTGAAGGACCGGTTCACCATCTCCAGAGACAGTTCCAAGAACACGGTG<br>TATCTGCAAATGAACAGCCTGAGAGCCGAGGACACGGCCGTATATTACTGTGTGAAACA<br>TGGTAGGGCCGGAATAAACTGGTACTTCGATCTCTGGGGCCGTGGCACCCTGGTGACCG<br>TCTCCTCA |
| SEQ ID 173 | CAGGTACAGCTGCAGCAGTCAGGTCCAGGACTGGTGAAGCCCTCGCAGACCCTCTCACT<br>CACCTGTGCCATCTCCGGGGACAGTGTCTCTAGCAACAGTGCTGCTTGGAACTGGATCA<br>GGCAGTCCCCATCGAGAGGCCTTGAGTGGCTGGGAAGGACATACTACAGGTCCAAGTGG<br>TATAATGATTATGCAGTATCTGTGAAAAGTCGAATAACCATCAACCCAGACACATCCAA<br>GAACCAGTTCTCCCTGCAGCTGAACTCTGTGACTCCCGAGGACACGGCTGTGTATTACTG<br>TGCAAGAGGGGAGGGCTTTGGGCTTTTGATATCTGGGGCCAAGGGACCACGGTCACCG<br>TCTCCTCA |
| SEQ ID 174 | GAGGTCCAGCTGGTGCAGTCTGGGGCTGAGGTGAAGAAGCCTGGGGCCTCAGTGAAGGT<br>CTCCTGCAAGGCTTCTGGATACACCTTCACCGGCTACTATATGCACTGGGTGCGACAGGC<br>CCCTGGACAAGGGCTTGAGTGGATGGGATGGATCAACCCTAACAGTGGTGGCACAAACT<br>ATGCACAGAAGTTTCAGGGCAGGGTCACCATGACCAGGGACACGTCCATCAGCACAGCC<br>TACATGGAGCTGAGCAGGCTGAGATCTGACGACACGGCCGTGTATTACTGTGCGAGAGA<br>CAAGATCGGCAGCTGTCCTTACTGGGGCCAGGGAACCCTGGTCACCGTCTCCTCA |
| SEQ ID 175 | CAGGTCACCTTGAAGGAGTCTGGTCCTACGCTGGTGAAACCCACACAGACCCTCACGCT<br>GACCTGCACCTTCTCTGGGTTCTCACTCAGCACTAGTGGAGTGGGTGTGGGCTGGATCCG<br>TCAGCCCCAGGAAAGGCCCTGGAGTGGCTTGCACTCATTTATTGGGATGATGATAAGC<br>GCTACAGCCCATCTCTGAAGAGCAGGCTCACCATCACCAAGGACACCTCCAAAAACCAG<br>GTGGTCCTTACAATGACCAACATGGACCCTGTGGACACAGCCACATATTACTGTGCACA<br>CAGACCGGATAGCAGCAGTCAATGTTTTGACTACTGGGGCCAGGGAACCCTGGTCACCG<br>TCTCCTCA |
| SEQ ID 176 | CAGGTCACCTTGAAGGAGTCTGGGGGAGGCGTGGTCCAGCCTGGGAGGTCCCTGAGACT<br>CTCCTGTGCAGCCTCTGGATTCACCTTCAGTAGCTATGCTATGCACTGGGTCCGCCAGGC<br>TCCAGGCAAGGGGCTGGAGTGGGTGGCAGTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAGAAG<br>CAGTGGCTGGTCACTGCCTGAAGACTACTGGGGCCAGGGAACCCTGGTCACCGTCTCCT<br>CA |
| SEQ ID 177 | CAGGTCCAGCTGGTACAGTCTGGGGCTGAGGTGAAGAAGCCTGGGGCCTCAGTGAAGGT<br>CTCCTGCAAGGTTTCCGGATACACCCTCACTGAATTATCCATGCACTGGGTGCGACAGGC<br>TCCTGGAAAGGGCTTGAGTGGATGGGAGGTTTTGATCCTGAAGATGGTGAAACAATCT<br>ACGCACAGAAGTTCCAGGGCAGAGTCACCATGACCGAGGACACATCTACAGACACAGC<br>CTACATGGAGCTGAGCAGCCTGAGATCTGAGGACACGGCCGTGTATTACTGTGCAACGG<br>ATGTGAACCCGGAGCTACTGGGGGCGGGATTTGACTACTGGGGCCAGGGCACCCTGGTC<br>ACCGTCTCCTCA |

TABLE 3-continued

VH DNA Sequences

| SEQ ID | VH DNA Sequence |
|---|---|
| SEQ ID 178 | CAGGTCACCTTGAAGGAGTCTGGGGGAGGCTTGGTCCAGCCTGGAGGGTCCCTGAGACT<br>CTCCTGTGCAGCCTCTGGATTCACCTTCAGTGACCAGTACATGGACTGGGTCCGCCAGGC<br>TCCAGGGAAGGGGCTGGAGTGGGTTGGCCGTGTTAGAAACAAAGCTAACAGTTACACCA<br>CAGAATACGCCGCGTCTGTGAAAGGCAGATTCACCATCTCAAGAGATGATTCAAAGAAC<br>TCACTGTATCTGCAAATGAATAGTCTGAACACCGAGGACACGGCCATGTATTTCTGTGCT<br>AGTAGTCTCAATAGTGGGGGCTACCGATGCTTCCATCACTGGGGCCAGGGCACCCTGGT<br>GACCGTCTCCTCA |
| SEQ ID 179 | CAGGTCCAGCTGGTGCAGTCTGGGGGAGGCTTGGTCCAGCCTGGGGGGTCCCTGAGACT<br>CTCCTGTTCAGCCTCTGGATTCACCTTCAGTAGCTATGCTATGCACTGGGTCCGCCAGGC<br>TCCAGGGAAGGGACTGGAATATGTTTCAGCTATTAGTAGTAATGGGGGTAGCACATACT<br>ACGCAGACTCAGTGAAGGGCAGATTCACCATCTCCAGAGACAATTCCAAGAACACGCTG<br>TATCTTCAAATGAGCAGTCTGAGAGCTGAGGACACGGCTGTGTATTACTGTGTGAAAGC<br>GCCGAGGGGTGTAGTACCAGCTGCTATGCGGGGGGGCTACTGGGGCCAGGGAACCCTG<br>GTCACCGTCTCCTCA |
| SEQ ID 180 | CAGGTGCAGCTGCAGGAGTCGGGGGGAGGCTTGGTACAGCCAGGGCGGTCCCTGAGAC<br>TCTCCTGTACAGCTTCTGGATTCACCTTTGGTGATTATGCTATGAGCTGGTTCCGCCAGG<br>CTCCAGGGAAGGGGCTGGAGTGGGTAGGTTTCATTAGAAGCAAAGCTTATGGTGGGACA<br>ACAGAATACGCCGCGTCTGTGAAAGGCAGATTCACCATCTCAAGAGATGATTCCAAAAG<br>CATCGCCTATCTGCAAATGAACAGCCTGAAAACCGAGGACACAGCCGTGTATTACTGTA<br>CTAGATTGGTGGGCAATAGTGGGAGCTACTATCCGTTTGGGTACTGGGGCCAGGGAACC<br>CTGGTGACCGTCTCCTCA |
| SEQ ID 181 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCGGTGACCGCCGCGGACACGGCTGTGTATTACTGTGCGAGAGGCC<br>GGTCCCTTCCCTACCGGGGGTTGGCTCCTAGATCTTTCGGAGGATACTACTTTGACTACT<br>GGGGCCAGGGAACCCTGGTCACCGTCTCCTCA |
| SEQ ID 182 | CAGGTGCAGCTGCAGGAGTCGGGGGGAGGCTTGGTACGCCTGGAGGGTCCCTGAGACT<br>CTCCTGTGGAGACTCTGGATTCAACTTCAGTGGATATGAAATGAACTGGGTCCGCCAGG<br>CTCCAGGGAAGGGGCTGGAGTGGGTTTCATACGTACCAGTACTAGTGGTAGTACCAGATAC<br>TACGCAGACTCTGTGAAGGGCCGATTTACCATCTCCAGAGACAACGCCAAGAACACCCT<br>GTATTTGCAAATGAACAGTCTGAGAGTCGAGGACACGGCTGTGTATTACTGTGCAAGAG<br>GACGGACTCACTGGGCCCCCAGGACTTTGACTACTGGGGCCAGGGAACCCTGGTCACC<br>GTCTCCTCA |
| SEQ ID 183 | CAGGTGCAGCTGCAGGAGTCGGGGGGAGGCTTGGTACAGCCTGGGGGGTCCCTGAGACT<br>CTCCTGTGCAGCCTCTGGATTCACCTTTAGCAGCTATGCCATGAGCTGGGTCCGCCAGGC<br>TCCAGGGAAGGGGCTGGAGTGGGTCTCAGCTATTAGTGGTAGTGGTGGTAGCACATACT<br>ACGCAGACTCCGTGAAGGGCCGGTTCACCATCTCCAGAGACAATTCCAAGAACACGCTG<br>TATCTGCAAATGAACAGCCTGAGAGCCGAGGACACGGCCGTATATTACTGTGCGAAAGG<br>AGGAATGTATTACTATGGTTCGGGGAGCTCGTACTTTGACTACTGGGGCCAGGGAACCC<br>TGGTGACCGTCTCCTCA |
| SEQ ID 184 | CAGGTGCAGCTGGTGCAATCTGGGGGAGGCTTGGTACAGCCTGGGGGGTCCCTGAGACT<br>CTCCTGTGCAGCCTCTGGATTCACCTTTAGCAGCTATGCCATGAGCTGGGTCCGCCAGGC<br>TCCAGGGAAGGGGCTGGAATGGGTCTCAGGTATTAGTGGTAGTGGTGGTAGCACATACT<br>ACGCAGACTCCGTGAAGGGCCGGTTCACCATCTCCAGAGACAATTCCAAGAACATGCTG<br>TTTCTGCAAATGAACAGCCCGAGAGCCGAGGACACGGCCGTATATTACTGTGCAAGAA<br>AATAGCAGCAGCTGGTAAGCAACCTGTTGACTACTGGGGCCAGGGAACCCTGGTCACCG<br>TCTCCTCA |
| SEQ ID 185 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCTGTGACCGCCGCGGACACGGCTGTGTATTACTGTGCGAGAAGGA<br>AGGTGTATGATTACGTTTGGGGGAGTTATCGCCTCCCCGGGTCGGTATCGTACTACTTTG<br>ACTACTGGGGCCAGGGAACCCTGGTCACCGTCTCCTCA |
| SEQ ID 186 | CAGGTCCAGCTGGTACAGTCTGGAGCAGAGGTGAAAAAGCCCGGGGAGTCTCTGAAGA<br>TCTCCTGTAAGGGTTCTGGATACAGCTTTACCAGCTACTGGATCGGCTGGGTGCGCCAGA<br>TGCCCGGGAAAGGCCTGGAGTGGATGGGGATCATCTATCCTGGTGACTCTGATACCAGA<br>TACAGCCCGTCCTTCCAAGGCCAGGTCACCATCTCAGCCGACAAGTCCATCAGCACCGC<br>CTACCTGCAGTGGAGCAGCCTGAAGGCCTCGGACACCGCCATGTATTACTGTGCGAGAC<br>TCCCGGGGAGAGCAGCTCGTCCAGACTACTGGGGCCAGGGCACCCTGGTCACCGTCTCC<br>TCA |

TABLE 3-continued

VH DNA Sequences

| SEQ ID | VH DNA Sequence |
| --- | --- |
| SEQ ID 187 | CAGGTCACCTTGAAGGAGTCTGGGGGAGGCGTGGTCCAGCCTGGGAGGTCCCTGAGACT<br>CTCCTGTGCAGCCTCTGGATTCACCTTCAGTAGCTATGCTATGCACTGGGTCCGCCAGGC<br>TCCAGGCAAGGGGCTGGAGTGGGTGGCAGTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAGAGG<br>CCCCGGGGCAGTGGCTGGTACTAAGCCAAAGTACTACTTTGACTACTGGGGCCAGGGAA<br>CCCTGGTCACCGTCTCCTCA |
| SEQ ID 188 | GAGGTCCAGCTGGTGCAGTCTGGGGGAGGCGTGGTCCAGCCTGGGAGGTCCCTGAGACT<br>CTCCTGTGCAGCCTCTGGATTCACCTTCAGTAGCTATGCTATGCACTGGGTCCGCCAGGC<br>TCCAGGCAAGGGGCTGGAGTGGGTGGCAGTTATATCATATGATGGAAGTAATAAATACT<br>ACGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAGGGC<br>CACGTATTACTATGATAGTAGTGGTTATAGGTTTGACTACTGGGGCCAGGGAACCCTGGT<br>CACCGTCTCCTCA |
| SEQ ID 189 | GAGGTCCAGCTGGTACAGTCTGGGGGAGGCTTGGTAGAACCGGGGGGGTCCCTTAGACT<br>CTCCTGTGCAGCCTCTCGATTCACTTTCAGTGACGCCTGGATGAGCTGGGTCCGCCAGGC<br>TCCAGGTAAGGGGCTGGAGTGGGTTGGCCGTATTAAAAGCAAATAAGTGGTGGGACA<br>ACAGACTACGCTGCACCCGTGCAAGGCAGATTCACCATCTCAAGAGATGATTCAAAAAA<br>CACGCTGTATCTGCAAATGGACAGCCTGAAAACCGAGGACACAGCCGTGTATTACTGTG<br>CGAACCGAAACTTAGGCTACTGGGGCCAGGGCACCCTGGTGACCGTCTCCTCA |
| SEQ ID 190 | GAGGTCCAGCTGGTGCAGTCTGGGCTGAGGTGAAGAAGCCTGGGGCCTCAGTGAAGGT<br>TTCCTGCAAGGCTTCTGGATACACCTTCACTAGCTATGCTATGCATTGGGTGCGCCAGGC<br>CCCCGGACAAAGGCTTGAGTGGATGGGATGGATCAACGCTGGCAATGGTAACACAAAA<br>TATTCACAGAAGTTCCAGGGCAGAGTCACCATGACCACAGACACATCCACGAGCACAGC<br>CTACATGGAGCTGAGGAGCCTGAGATCTGACGACACGGCCGTGTATTACTGTGCGAGAG<br>CTCGTTACTATGATAGTAGTGGTTATATTGCCCCATCGGGTTACTTTGACTACTGGGGCC<br>AGGGAACCCTGGTCACCGTCTCCTCA |
| SEQ ID 191 | CAGGTGCAGCTGGTGCAGTCTGGGGCTGAGGTGAAGAAGCCTGGGGCCTCAGTGAAGGT<br>TTCCTGCAAGGCTTCTGGATACACCTTCACTAGCTATGCTATGCATTGGGTGCGCCAGGC<br>CCCCGGACAAAGGCTTGAGTGGATGGGATGGATCAACGCTGGCAATGGTAACACAAAA<br>TATTCACAGAAGTTCCAGGGCAGAGTCACCATTACCAGGGACACATCCGCGAGCACAGC<br>CTACATGGAGCTGAGCAGCCTGAGATCTGAAGACACGGCTGTGTATTACTGTGCGAGAG<br>ATGGCCCCGCCGTTGATGGTGCTGAATACTTCCAGCACTGGGGCCAGGGCACCCTGGTC<br>ACCGTCTCCTCA |
| SEQ ID 192 | CAGCTGCAGCTGCAGGAGTCGGGTCCAGGACTGGTGAAGCCCTCGCAGACCCTCTCACT<br>CACCTGTGCCATCTCCGGGGACAGTGTCTCTAGCAACAGTGCTGCTTGGAACTGGATCA<br>GGCAGTCCCCATCGCGAGGCCTTGAGTGGCTGGGAAGGACTTACTACAGGTCCAAGTGG<br>TATAATGATTATGCAGTATCTCTGAAAAGTCGAATAACCATCAACCCGGACACATCCAA<br>GAACCAGTTCTCCCTGCAGCTGAACTCTGTGACTCCCGAGGACACGGCTGTATATTACTG<br>TGCAAGTTTGGCGAGTGGTTCCCCCCCTCCGGGGGACTACTGGGGCCAGGGAACCCTGG<br>TGACCGTCTCCTCA |
| SEQ ID 193 | CAGGTCACCTTGAAGGAGTCTGGGGGAGGCGTGGTCCAGCCTGGGAGGTCCCTGAGACT<br>CTCCTGTGCAGCCTCTGGATTCACCTTCAGTACCTATGGCATGCACTGGGTCCGCCAGGC<br>TCCAGGCAAGGGGCTGGAGTGGGTGGCACTTATATCATATGATGGAAGTAAAAAATACT<br>ATGCAAACTCCGTGAAGGGCCGATTCACCATCTCCAGAGACAATTCCAAGAACACGTTG<br>TATCTGCAAATGAAAAGTCTGAGAGCTGAGGACACGGCTATGTATTACTGTGCGAAAGG<br>CCCTATAGTGGGAGCGACTATGGACTACTGGGGCCAGGGAGCCCTGGTCACCGTCTCCT<br>CA |
| SEQ ID 194 | GAGGTGCAGCTGGTGCAGTCTGGGCTGAGGTGAAGAAGCCTGGGTCCTCGGTGAAGGT<br>CTCCTGCAAGGCTTCTGGAGGCACCTTCAGCAGCTATGCTATCAGCTGGGTGCGACAGG<br>CCCCTGGACAAGGGCTTGAGTGGATGGGATGGATCAGCGCTTACAATGGTAACACAAAC<br>TATGCACAGAAGCTCCAGGGCAGAGTCACCATGACCACAGACACATCCACGAGCACAG<br>CCTACATGGAGCTGAGGAGCCTGAGATCTGACGACACGGCCGTGTATTACTGTGCGAGA<br>TGGTACGGTGACTACGGCCTTGACTACTGGGGCCAGGGAACCCTGGTCACCGTCTCCTC<br>A |
| SEQ ID 195 | GAGGTCCAGCTGGTGCAGTCTGGGCTGAGGTGAAGAAGCCTGGGGCCTCAGTGAAGGT<br>TTCCTGCAAGGCTTCTGGATACACCTTCACTAGCTATGCTATGCATTGGGTGCGCCAGGC<br>CCCCGGACAAAGGCTTGCGTGGATGGGATGGATCAACGCTGGCAATGGTAACACAAAAT<br>ATTCAGAGAAGTTCGAAGGCAGAGTCACCATCACCAGGGACACATCCGCGAGCACAGC<br>CTACATGGAGCTGAGCAGCCTGAGATCTGAAGACACGGCTGTGTATTACTGTGCGAGGG<br>TCGCCAAATATTATTACGAGAGTGGTGGTTATCGGGCCTCCAACTGGTTCGACCCCTGGG<br>GCCAGGGCACCCTGGTCACCGTCTCCTCA |

TABLE 3-continued

VH DNA Sequences

| SEQ ID | VH DNA Sequence |
|---|---|
| SEQ ID 196 | CAGGTGCAGCTGCAGGAGTCAGGTCCAGGACTGGTGAAGCCCTCGCAGACCCTCTCACT<br>CACCTGTGCCATCTCCGGGGACAGTGTCTCTAGCAACAGTGCTGCTTGGAACTGGATCA<br>GGCAGTCCCCATCGAGAGGCCTTGAGTGGCTGGGAAGGACATACTACAGGTCCAAGTGG<br>TATAATGATTATGCAGTATCTGTGAAAAGTCGAATAACCATCAACCCAGACACATCCAA<br>GAACCAGTTCTCCCTGCAGCTGAACTCTGTGACTCCCGAGGACACGGCTGTGTATTACTG<br>TGCAAGAGCGCCCCTCCGACTGTTGGCTGGTACGCCCCCGTCTTTGACTACTGGGGCCA<br>GGGAACCCTGGTCACCGTCTCCTCA |
| SEQ ID 197 | CAGCTGCAGCTGCAGGAGTCCGGGGGAGGCTTAGTTCAGCCGGGGGGGTCCCTGAGACT<br>CTCCTGCTCAGCCTCTGGAATCAGCTTCAGAGATTACTGGATGCACTGGATCCGCCAAAC<br>TCCAGGGAAGGGGCTGGTGTGGGTCTCACGTATTAATCCTGATGGGAGTAGCACAAGCT<br>ACGCGGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAAAGT<br>TACGGGACGGAGAGTGGGAGCCCATGACTACTGGGGCCAGGGAACCCTGGTCACCGTCT<br>CCTCA |
| SEQ ID 198 | CAGGTGCAGCTGGTGCAGTCTGGGGCTGAGGTGAAGAAGCCTGGGGCCTCAGTGAAGGT<br>CTCCTGCAAGGCTTCTGGATACACCTTCACCGGCTACTATATGCACTGGGTGCGACAGGC<br>CCCTGGACAAGGGCTTGAGTGGATGGGATGGATCAACCCTAACAGTGGTGGCACAAACT<br>ATGCACAGAAGTTTCAGGGCAGGGTCACCATGACCAGGGACACGTCCATCAGCACAGCC<br>TACATGGAGCTGAGCAGGCTGAGATCTGACGACACGGCCGTGTATTACTGTGCCTTTGC<br>CCAGCCGGGCGCTGAGACGTTGAACTTCGATCTCTGGGGCCGTGGCACCCTGGTCACCG<br>TCTCCTCA |
| SEQ ID 199 | CAGGTACAGCTGCAGCAGTCAGGTCCAGGACTGGTGAAGCCCTCGCAGACCCTCTCACT<br>CACCTGTGCCATCTCCGGGGACAGTGTCTCTAGCAAAAGTGCTGCTTGGAACTGGATCA<br>GGCAGTCCCCATCGAGAGGCCTTGAGTGGCTGGGAAGGACATACTACAGGTCCAAATGG<br>AATAATGATTATGCATTATCTGTGAAAAGTCGAATAACCATCAACCCAGACACATCCAA<br>GAACCAGTTCTCCCTGCAGCTGAAGTCTGTGACTCCCGAGGACACGGCTCTGTATTACTG<br>TGTAAGACAAGTCGCGGGCGGTATGGACGTCTGGGGCCAAGGGACCACGGTCACCGTCT<br>CCTCA |
| SEQ ID 200 | CAGGTGCAGCTGGTGCAATCTGGGGGAGGCTTGGTACAGCCAGGGCGGTCCCTGAGACT<br>CTCCTGTACAGCTTCTGGATTCACCTTTGGTGATTATGCTATGAGCTGGTTCCGCCAGGC<br>TCCAGGGAAGGGGCTGGAGTGGGTCTCAGCTATTAGTGGTAGTGGTGGTAGCACATACT<br>ATGCAGACTCCGTGAAGGGCCGATTCACCATCTCCAGAGACAATTCCAAGAACACGCTG<br>TATCTGCAAATGAACAGCCTGAGAGCTGAGGACACGGCTGTGTATTACTGTGCGAAAGG<br>ATCGGTATATAGTGGGAGCTACTATATGCTCATTGACTACTGGGGCCAGGGCACCCTGG<br>TCACCGTCTCCTCA |
| SEQ ID 201 | CAGGTACAGCTGCAGCAGTCAGGTCCAGGACTGGTGAGGCCCTCGCAGACCCTCTCACT<br>CACCTGTGTCATCTCCGGGGACAGTGTCTCTAGCGGCAGTGCTGCTTGGAACTGGATCAG<br>GCAGTCCCCATCGAGAGGCCTTGAGTGGCTGGGAAGGACATATTATAGGGCCAAGTGGT<br>ATAATGAATATGCAGGGTCTGTGAAAAGCCGAATAACCATCAGTCCGGACACATCCAAG<br>AACCAGTTCTCCCTGCAACTGAACTCTGTGACTCCCGAGGACACGGCTGTGTATTTCTGT<br>ACAAGACAAGACAAAGACAACACGAGATATTCCGGTTTGGGCGTCTGGGGCCAAGGGA<br>CCACGGTGACCGTCTCCTCA |
| SEQ ID 202 | GAGGTGCAGCTGGTGGAGACCGGGGGAGGCTTAGTTCAGCCTGGGGGGTCCCTGAGACT<br>CTCCTGTGCAGCCTCTGAATTCACCCTTAGGAACTATGGCGTGAGCTGGGTCCGCCAGGC<br>TCCAGGGAAGGGGCTGGAGTGGGTCTCAGGTATGAGTGGTAGTGGTTATAGTACATACT<br>ACGCAGACTCCGTGAAGGGCCGGTTCACCATCTCCAGAGACAGTTCCAAGAACACGCTG<br>TTTCTGCAAATGGACAGCCTGAGAGCCGAGGACACGGCCATATATTACTGTGCGAGAGG<br>GCCCCGAATGTGGAGCAGTGGCATTGATGCTTTTGATATCTGGGGCCACGGGACAATGG<br>TGACCGTCTCTTCA |
| SEQ ID 203 | CAGGTGCAGCTACAGCAGTGGGGCGCAGGACTGTTGAAGCCTTCGGAGACCCTGTCCCT<br>CACCTGCGCTGTCTATGGTGGGTCCGTCAGTGGTTACTACTGGAGCTGGATCCGCCAGCC<br>CCCAGGGAAGGGGCTGGAGTGGATGGGGGAAATCCATCATAGTGGAAGCACCAACTAC<br>AACCCGTCCCTCAAGAGTCGAGTCACCATATCACTAGACACGCCCAAGAACCAGTTCTC<br>CCTGAAGCTAAGCTCTGTGACCGCCGCGGACACGGCTGTATATTACTGTGCGAGACGGG<br>ATTGGGCAGGAAAAGGGTCTGGGGCCAGGGAACCCTGGTCACCGTCTCCTCA |
| SEQ ID 204 | CAGGTACAGCTGCAGCAGTCAGGTCCAGGACTATTAAAGCCCTCGCAGACCCTCTCACT<br>CACCTGTGCCATCTCCGGGGACAGTGTCTCTAGCAACACTGCTACTTGGAACTGGATCAG<br>GCAGTCCCCATCGAGAGGCCTTGAGTGGCTGGGAAGGACATACTACAGGTCCAAGTGGT<br>ATAAGGATAATGCACTGTCTGTGAAAAGTCGAATAACCATCAACCCAGACACATCCAAG<br>AACCAGTTCTCCCTGCAGCTGAACTCTGTGACTCCCGAGGACACGGCTGTGTATTACTGT<br>GCAGGAGGTCGGGCTGGTATTGCCGCTTTTGATATCTGGGGCCAAGGGACCACGGTCAC<br>CGTCTCCTCA |

TABLE 3-continued

VH DNA Sequences

| SEQ ID | VH DNA Sequence |
|---|---|
| SEQ ID 205 | CAGGTGCAGCTGGTGCAATCTGGAGGAGGCTTGATCCAGCCTGGGGGGTCCCTGAGACT<br>CTCCTGTGCAGCCTCTGGGTTCACCGTCAGTAGCAACTACATGAGCTGGGTCCGCCAGGC<br>TCCAGGGAAGGGGCTGGAATGGGTCTCACTTATTTATAGTGATGGTCGCACAAACTATG<br>CAGACTCCGTGAAGGGCCGATTCACCATCTCCAGAGACAATTCCAAGAACACGCTGTAT<br>CTGCAAATGAACAGCCTGAGAGCCGAGGACACGGCCGTATATTACTGTGCGAAGGGGG<br>CCCTACAGGGCGAATGGCGGAGATTTGACTACTGGGGCCAGGGCACCCTGGTCACCGTC<br>TCCTCA |
| SEQ ID 206 | CAGGTGCAGCTACAGCAGTCAGGTCCAGGACTGGTGAAGCCCTCGCAGACCCTCTCACT<br>CACCTGTGCCATCTCCGGGGACAGTGTCTCTAGCAACAGTGCTGCTTGGAACTGGATCA<br>GGCAGTCCCCATCGAGAGGCCTTGAGTGGCTGGGAAGGACATATTACAGGTCCAAGTGG<br>TATAATGATTATGCAGTATCTGTGAAAAGTCGAATAACCATCAACCCAGACACATCCAA<br>GAACCAGTTCTCCCTGCAGCTGAACTCTGTGACTCCCGAGGACACGGCTGTGTATTACTG<br>TACAAGAACCAACCAGGGATACGGTGGTAACTCCGGGGTATTTGACTACTGGGGCCAGG<br>GAACCCTGGTCACCGTCTCCTCA |
| SEQ ID 207 | CAGGTGCAGCTACAGCAGTCAGGTCCAGGACTGGTGAAGCCCTCGCAGACCCTCTCACT<br>CACCTGTGCCATCTCCGGGGACAGTGTCTCTGGCAACAGTGCTGCTTGGAACTGGATCA<br>GGCAGTCCCCATCGAGAGGCCTTGAGTGGCTGGGAAGGACATACTACAGGTCCAAGTGG<br>TATAATGATTATGCAGTATCTGTGAAAAGTCGAATAACCATCAACCAGACACATCCAA<br>GAACCAGTTCTCCCTGCAGTTGAATTCTGTGACTCCCGAGGACACGGCTGTGTATTACTG<br>TGCGAGGATAGTGGGAGGTGCCGTTGACTGCTGGGGCCAGGGAACCCTGGTGACCGTCT<br>CCTCA |
| SEQ ID 208 | GAGGTGCAGCTGGTGCAGTCTGGGGCTGAGGTGAAGAAGCCTGGGGCCTCAGTGAAGG<br>TTTCCTGCAAGGCTTCTGGATACACCTTCACTAGCTATGCTATGCATTGGGTGCGCCAGG<br>CCCCCGGACAAAGGCTTGAGTGGATGGGATGGATCAACGCTGGCAATGGTAACACAAA<br>ATATTCACAGAAGTTCCAGGGCAGAGTCACCATTACCAGGGACACATCCGCGAGCACAG<br>CCTACATGGAGCTGAGCAGCCTGAGATCTGAAGACACGGCTGTGTATTACTGTGCGAGA<br>GTTAGAGTGGGAGCTACTACTGTTTACGACAGCTGGTTCGACCCCTGGGGCCAGGGAAC<br>CCTGGTGACCGTCTCCTCA |
| SEQ ID 209 | CAGGTGCAGCTGGTGCAGTCTGGGGGAGGCTTGGTACAGCCTGGGGGGTCCCTGAGACT<br>CTCCTGTGCAGCCTCTGGATTCACCTTTAGCAGCTATGCCATGAGCTGGGTCCGCCAGGC<br>TCCAGGGAAGGGGCTGGAGTGGGTCTCAGCTATTAGTGGTAGTGGTGGTAGCACATACT<br>ACGCAGACTCCCGTGAAGGGCCGGTTCACCATCTCCAGAGACAATTCCAAGAACACGCTG<br>TATCTGCAAATGAACAGCCTGAGAGCCGAGGACACGGCCGTATATTACTGTGCGAAAGA<br>TGGGGGGTCCAGCCCATACTATGATAGTAGTGGTTTACTACCCTGGTACTTCGATCTCTG<br>GGGCCGTGGCACCCTGGTCACCGTCTCCTCA |
| SEQ ID 210 | CAGGTGCAGCTGCAGGAGTCGGGGGGAGGCTTGGTCCAGCCTGGGGGGTCCCTGAGACT<br>CTCCTGTGCAGCCTCTGGATTCACCTTCAGTAGCTATGCTATGCACTGGGTCCGCCAGGC<br>TCCAGGGAAGGGACTGGAATATGTTTCAGCTATTAGTAGTAATGGGGGTAGCACATATT<br>ATGCAAACTCTGTGAAGGGCAGATTCACCATCTCCAGAGACAATTCCAAGAACACGCTG<br>TATCTTCAAATGGGCAGCCTGAGAGCTGAGGACATGGCTGTGTATTACTGTGCGAGAGC<br>TAAGTTTTGGACATACTACTTTGACTACTGGGGCCAGGGAACCCTGGTGACCGTCTCCTC<br>A |
| SEQ ID 211 | CAGGTGCAGCTACAGCAGTGGGGCGCAGGACTGTTGAAGCCTTCGGAGACCCTGTCCCT<br>CACCTGCGCTGTCTATGGTGGGTCCTTCAGTGGTTACTACTGGAGCTGGATCCGCCAGCC<br>CCCAGGGAAGGGGCTGGAGTGGATTGGGGAAATCAATCATAGTGGAAGCACCAACTAC<br>AACCCGTCCCTCAAGAGTCGAGTCACCATATCAGTAGACACGTCCAAGAACCAGTTCTC<br>CCTGAAGCTGAGCTCTGTGACCGCCGCGGACACGGCTGTGTATTACTGTGCGAGAGGCG<br>GTGGTTCGGGGAGTTATTATAAGAGGTTCTTTGACTACTGGGGCCAGGGAACCCTGGTC<br>ACCGTCTCCTCA |
| SEQ ID 212 | GAGGTGCAGCTGGTGCAGTCTGGAGCTGAGGTGAGGAAGCCTGGGGCCTCAGTGAAGG<br>TCTCCTGCAAGGCTTCTGGTTACACATTTACCAGTTATGCCATCAGCTGGGTGCGACAGG<br>CCCCTGGACAAGGGCTTGAGTGGATGGGGTGGATCAGCGCTTACGACGGTAACACAAAC<br>TATGCACAGAAGCTCCAGGGCAGAGTCACCATGACCACAGACACATCCACGAGCACAG<br>CCTACATGGAGGTGAGGAGCCTGAGATCTGACGACACGGCCGTGTATTACTGTGCGAGA<br>GATGGTACGGTCCGAAGGGGTAGTGGGAGCTACTACCCCTGGAAACTTTGACTACAGGGG<br>CCAGGGAACCCTGGTCACCGTCTCCTCA |
| SEQ ID 213 | GAGGTGCAGCTGGTGCAGTCTGGGGGAGGCGTGGTCCAGCCTGGGAGGTCCCTGAGACT<br>CTCCTGTGCAGCGTCTGGATTCACCTTCAGTAGCTATGGCATGCACTGGGTCCGCCAGGC<br>TCCAGGCAAGGGGCTGGAGTGGGTGGCAGTTATATGGTATGATGGAAGTAATAAATACT<br>ATGCAGACTCCGTGAAGGGCCGATTCACCATCTCCAGAGACAATTCCAAGAACACGCTG<br>TATCTGCAAATGAACAGCCTGAGAGCCGAGGACACGGCTGTGTATTACTGTGCGAGAGA<br>TCTGAATCGAGGATATTGTAGTGGTGGTAGCTGCTTTGGCTACTGGGGCCAGGGAACCC<br>TGGTCACCGTCTCCTCA |

TABLE 3-continued

VH DNA Sequences

| SEQ ID | VH DNA Sequence |
|---|---|
| SEQ ID 214 | CAGGTGCAGCTGCAGGAGTCTGGGGGAGGCTTGGTACAGCCGGGGGGGTCCCTGAGACT CTCCTGTGCAGCCTCTGGATTCACCTTTAGCAGCTATGCCATGAGCTGGGTCCGCCAGGC TCCAGGGAAGGGGCTGGAGTGGGTTTCATACATTAGTAGTAGTGGTACTACCATATACT ACGCAGACTCTGTGAAGGGCCGATTCACCGTCTCCAGAGACAATGCCAAGAACTCACTG TATCTGCAAATGAACAGCCTGAGAGCCGAGGACACGGCCGTGTATTACTGTGCGAGGGA TTATAGCAGCTCGGGGGAGTGCTTTGACTACTGGGGCCAGGGAACCCTGGTCACCGTCT CCTCA |
| SEQ ID 215 | GAGGTGCAGCTGGTGCAGTCTGGGGGAGGCGTGGTCCAGCCTGGGAGGTCCCTGAGACT CTCCTGTGCAGCGTCTGGATTCACCTTCAGTAGCTATGGCATGCACTGGGTCCGCCAGGC TCCAGGCAAGGGGCTGGAGTGGGTGGCAGTTATATGGTATGATGGAAGTAATAAATACT ATGCAGACTCCGTGAAGGGCCGATTCACCATCTCCAGAGACAATTCCAAGAACACGCTG TATCTGCAAATGAACAGCCTGAGAGCCGAGGACACGGCTGTGTATTACTGTGCGAGAGA TCAGGCAGCTATGGTAGGCTACTTTGACTACTGGGGCCAGGGAACCCTGGTCACCGTCT CCTCA |
| SEQ ID 216 | CAGGTCACCTTGAAGGAGTCTGGGGGAGGCGTGGTCCAGCCTGGGAGGTCCCTGAGACT CTCCTGTGCAGCCTCTGGATTCATCTTCAGTAACTATGCTATACACTGGGTCCGCCAGGC TCCAGGCAAGGGGCTGGAGTGGGTGGCAGTTATATCATATGATGGAAGTAATAAATACT ACGCAGACTCCGTGAAGGGCCGATTCACCATCTCCAGAGACAATTCCAAGAACACGCTG TATCTGCAAATGAACAGCCTGAGAGCTGAGGACACGGCTGTGTATTACTGTGCGAGGAC TTTTGCGGGGTATAGCAGCAAACTGGGGTACTTCGATCTCTGGGGCCGTGGCACCCTGGT CACCGTCTCCTCA |

Exemplary VL amino acid sequences of CLEC2D antibodies of the disclosure are shown in Table 4 below. VL amino acid sequences having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to the sequences listed in Table 4 are considered within the scope of the disclosure.

TABLE 4

VL Amino Acid Sequences

| SEQ ID | VL Amino Acid Sequence |
|---|---|
| SEQ ID 217 | ETTLTQSPATLSVSLGERATLSCRASQSIGSNLVWYQL KPGQGPRLVIYSATSRATGIPARFSGSGSGTEFILSIS NLQSEDLAVYYCQQYGSSPPTTFGQGTRLEIKR |
| SEQ ID 218 | EIVMTQSPATLSLSPGERATLSCRASQSVSSSYLAWYQ QKPGRAPRLLIYGASNRATGIPDRFSGSGSGTDFTLII SRLEPEDFALYYCQQYGSSPGTFGQGTKVDIKR |
| SEQ ID 219 | DVVMTQSPATLSLSPGERATLSCRASQSVSSYLAWYQQ KPGQAPRLLIYDASNRATGIPARFSGSGSGTDFTLTIS SLEPEDFAVYYCQQRSNWPRTFGQGTKLEIKR |
| SEQ ID 220 | EIVLTQSPDSLAVSLGERATITCKSSRNILYSGNNKNF LAWYQHKPGQPPKLLIYWASTRESGVPDRFSGSGSGTD FTLTINSLEAEDAATYYCHQSSSLPHTFGPGTKVDIKR |
| SEQ ID 221 | ETTLTQSPGTLSLSPGQRATLSCRASESVSKSYLLWYQ QKPGQAPRLLIYGASTRASGIPNRFSGSGSGTDFTLTI SRLEPEDSAVYYCQHYGSSRTFGQGTRLEIKR |
| SEQ ID 222 | ETTLTQSPGTLSLSPGERATLSCRASQSISSTYLAWYQ QKPGQAPRLLIYGASTRATGIPDRFSGSGSGTDFTLSI SRLEPEDFAVYYCQQYGNSPPGATFGQGTRLEIKR |

TABLE 4-continued

VL Amino Acid Sequences

| SEQ ID | VL Amino Acid Sequence |
|---|---|
| SEQ ID 223 | DIQLTQSPSSLSASVGERVTITCRSSQALRNVVGLGDD LAWYQHTPGSAPKILIYSTSTLQSGVSSRFSGGKSGRD FTLTIDRLQPGDSATYYCLQHHDFPFTFGPGTKVEIKR |
| SEQ ID 224 | DVVMTQSPLSLPVTPGEPASISCRSSQSLLNSNGYNYL EWYLQKPGQSPQLLIYLGSNRASGVPDRFSGSGSGTDF TLKISRVEADDAGVYYCMQSLQTPLTFGGGTKLEIKR |
| SEQ ID 225 | ETTLTQSPGTLSLSPGERATLSCRASQSVSSSYLAWYQ QKPGQAPRLLIYGASSRATGIPDRFSGSGSGTDFTLTI SRLEPEDFAVYYCQQYGSSPRITFGQGTRLEIKR |
| SEQ ID 226 | DVVMTQSPATLSVSPGERATLSCRASQSVSSNLAWYQQ KPGQAPRLLIYGASTRATGIPARFSGSGSGTEFTLTIS SLQSEDFAVYYCQQYNNWPPMYTFGQGTKLEIKR |
| SEQ ID 227 | DVVMTQSPATLSVSPGERVTLSCRASQSVRDNVGWYKQ KPGQPPRLVIYGASTRATGIPARISGSGSGTEFTLTIS SLQSEDFAVYYCQQFNNWPYTFGQGTKLEIKR |
| SEQ ID 228 | DIQMTQSPSSLSASVGDRVTITCRASQSISSYLNWYQQ KPGKAPNLLIYAASSLHTGVPSRFSGSGSGTDFTLTIS SLQPEDFATYYCQQSYSIPRTFGQGTKVEIKR |
| SEQ ID 229 | DVVMTQSPATLSVTPGERATLSCRASQSVNSNVAWYQQ KPGQAPRLLIYDVSTRATDIPARFSGSGSGTDFTLTIS RLDPEDFAVYYCQQCASSPPVTFGGGTKLEIKR |
| SEQ ID 230 | EIVMTQSPATLSLSPGERATLSCGASQSVSSSYLAWYQ QKPGLAPRLLIYDASSRATGIPDRFSGSGSGTDFTLTI SRLEPEDFAVYYCQQYGSSPRVTFGGGTKVDIKR |
| SEQ ID 231 | DVVMTQSPGTLSLSPGERATLSCRASQSVSSSALAWFQ QKPGQAPRLLIYDSSSRATGIPDSFSGSGSGTEFTLTI SSLQPEDFATYYCQQFNTYPNTFGQGTKLEIKR |
| SEQ ID 232 | DIQMTQSPLSLPVTPGEPASISCRSSQSLLHSNGYNYL DWFLQKPGQSPRLLIYMGSSRASGVPERFSGSGSGTDF TLKISRVEAEDVGVYYCMQTLHTVTFGGGTKVEIKR |
| SEQ ID 233 | ETTLTQSPGTLSLSPGERATLSCRASQSVSSSYLAWYQ QKPGQAPRLLIYGASSRATGIPDRFSGSGSGTDFTLTI SRLEPEDFAVYYCQQYGSSLLFGQGTRLEIKR |

TABLE 4-continued

VL Amino Acid Sequences

| SEQ ID | VL Amino Acid Sequence |
|---|---|
| SEQ ID 234 | DIQLTQSPSFLSASVGDRVTITCRASQGISSSLAWYQQKPGKAPKLLIYAASTLQSGVPSRFSGSGSGTDFTFTISSLQPEDIATYYCQQYDNLPPLTFGGGTKVEIKR |
| SEQ ID 235 | DVVMTQSPLSLPVTPGEPASISCRSSQSLLHSNGYNYLDWYLQKPGQSPQLLIYLGSNRASGVPDRFSGSGSGTDFTVKISRVEAEDVGVYYCMQALQTPYTFGQGTKLEIKR |
| SEQ ID 236 | EIVLTQSPLSLPVTLGQPASISCRSCQSLVYSDGNTYLNCFQQRPGQSPRRLIYKVSNRDSGVPDRFSGSGSGTDFTLEISRVEAEDVGIYFCMQGLQTPFTFGPGTKVDIKR |
| SEQ ID 237 | DVVMTQSPGTLSLSPGERATLSCRASQSVSSSYLAWYQQKPGQAPRLLIYGASSRATGIPDRFSGSGSGTDFTLTISRLEPEDFAVYYCQQYGSSPALTFGGGTKLEIKR |
| SEQ ID 238 | EIVMTQSPLSLPVTPGEPASISCRSSQSLLHSNGYNYLDWYLQKPGQSPQLLIYLGSTRASGVPDRFSGSGSGTDFTLKISRAEAEDVGVYYCMQALHTPWTFGLGTKVDIKR |
| SEQ ID 239 | DIQMTQSPATLSVSPGERATLFCRASEGLTTNLAWYQHKPGQAPRLLIYAASTRATGVPARFSGSGSGTDFTLTISSLQSEDSAVYYCQQYNHWPLYTFGQGTKVEIKR |
| SEQ ID 240 | DIQLTQSPSTLSLSPGERATLSCRASQSVSSYLAWYQQKSGQAPRLLIYDASNRATGIPARFSGSGSGTDFTLTISSLEPEDFAVYYCQQGSNWPLTFGGGTKVEIKR |
| SEQ ID 241 | DIVMTHTPLSSPVTLGQPASISCRSSQSLEHTDGNTYLSWLHQRPGQPPRLLIYKVSTRFSGVPDRFSGSGAGTDFTLKISRVEAEDVGVYYCVQATHYPRTFGHGTKVEIKR |
| SEQ ID 242 | EIVLTQSPGTLSLSPGERATLSCRASQSISGSYLAWYQQKRGQAPRLLIYDASSRAEGIPDRFIGSGSGTDFTLTISRLEPEDFAMYYCQQYGSSPIFTFGPGTKVDIKR |
| SEQ ID 243 | EIVLTQSPDSLPVTPGEPASISCRSSQSLLHSNGNNYLDWYLQKPGQSPQLLIYLGSNRASGVPDRFSGSGSGTDFTLKLSRVEAEDVGVYYCMQGLQIPITFGPGTKVDIKR |
| SEQ ID 244 | DIQMTQSPSSVSASVGDRVTITCRASQNIRHWLVWYQQKLGQAPKLLIYAASNLQSGVPSRFSGSGSGTEFTLTINSLQAEDFATYYCLQHNSYPWTFGQGTKVEIKR |
| SEQ ID 245 | EIVLTQSPDFQSVTPKQKVTITCRASQSIGGSLHWYQQKPGQSPKLIIKYASQSFSGVPSRFSGSGSGTDFTLTIDSLEAEDAATYYCHQSISLPLTFGGGTKVDIKR |
| SEQ ID 246 | ETTLTQSPGTLSLSPGEGATLSCRASQSVTSNYLAWYQQKPGQAPRLLIYGASYRATGIPDRFSGSGSGTDFTLTISRLEPEDFAVYYCQQYASSVTFGQGTRLEIKR |
| SEQ ID 247 | DVVMTQSPATLSVSPGERATLSCRASQSISSNLAWYQQKPGQAPRLLIYGASTRATGIPARFSGSGSGTEFTLTISSLQSEDFAVYYCQQYNNWPRTFGQGTKLEIKR |
| SEQ ID 248 | DIQLTQSPDSLAVSLGERATINCKSSQSVLYSSNNKYLAWYQQKPGQPPKLLIYWASARESGVPDRFSGSGSGTDFTLTINSLQAEDVAVYYCQQFYSPPRTFGQGTKVEIKR |
| SEQ ID 249 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPGTFGGGTKVDIKR |
| SEQ ID 250 | EIVLTQSPGTLSLSPGERATLSCRASQSLSTNLAWYQQKPGQAPRLLIYGASTRATGIPARFSGSGSGTEFTLTITSLQSEDFAVYYCQQYHNWPPYTFGQGTKLEIKR |
| SEQ ID 251 | DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIKR |
| SEQ ID 252 | ETTLTQSPGTLSLSPGEGATLSCRASHSVGANYIAWYQQKPGQAPRLLIHTASKRATGVPERFSGSGSGTDFTLSISRLEPEDFAVYHCQQYAAAPITFGQGTRLEIKR |
| SEQ ID 253 | EIVMTQSPSSLSASVGDRVIITCRASQGIANYLAWYQQKPGKGPKLLIYASSTLQSGVPSRFSGSGSGTDFTLTISGLQPEDVATYYCQKYNSVPLTFGGGTKVDIKR |
| SEQ ID 254 | DVVMTQSPVSLAVSLGERATINCKSSQSVLYRTNNKNYLAWYQQKPGQPPKLLIYWASTRESGVPDRFSGSGSGTDFTLTISSLQPEDVAVYYCQQYYNLPRSFGQGTKLEIKR |
| SEQ ID 255 | DIVMTHTPDSLAVSLGERATINCKSNRSVLYSPNNQNYLGWYQQKPGQPPKLLIYWASTRDSGAPDRFSGSGSGTDFTLTINSLQAEDVAVYYCQQYASTPYTFGQGTKVEIKR |
| SEQ ID 256 | DVVMTQSPATLSLSPGERATLSCRASESVNSNFLAWYQQKPGQAPRLLIYAASTRATGIPARFSGSGSGTEFTLIITSLQSEDFAVYYCQQYNNWPLTFGGGTKLEIKR |
| SEQ ID 257 | DVVMTQSPATLSLSPGERATLSCRASQSVSSYLAWYQQKPGQAPRLLIYDASNRATGIPARFSGSGSGTDFTLTISSLEPEDFAVYYCQQRSNWSLTFGGGTKLEIKR |
| SEQ ID 258 | ETTLTQSPGTLSLSPGERATLSCRASQSVSSSYLAWYQQKPGQAPRLLIYGASTRATGIPDRFSGSGSGTDFTLTIGRLEPEDFAVYYCQHYGPSRRITFGQGTRLEIKR |
| SEQ ID 259 | ETTLTQSPDTLSVSPGGRATLSCRASQSIGSNLAWYQQKPGQSPRLLIYDASTRATGIPARFSGSGSGTEFTLTISSLESEDVLYYCQQHGEWPTFGQGTRLEIKR |
| SEQ ID 260 | DVVMTQSPATLSLSPGERATLSCRASQSVGNSLAWYQQKPGQAPRLLIYDASNRATGIPARFSGSGSGTDFTLTITSLEPEDFAIYYCQQRGTWPPLTFGGGTKLEIKR |
| SEQ ID 261 | DVVMTQSPSSLSASVGDTVTITCRASQSITNWLAWYQQKPGKAPKRLIYGASSLQSGVPSRFSGSGSGTEFTLTISSLQPEDFATYYCQQYTNYPRTFGQGTKLEIKR |
| SEQ ID 262 | DIQMTQSPSTLSASVGDRVTITCRARQSISNRLAWYQQKPGRAPNVLIYKASTLANGVPSRFSGSGSGTEFTLTISSLQPDDFATYYCQQYQSYWTFGPGTKVEIKR |
| SEQ ID 263 | DIQLTQSPATLSLSPGERATLSCKASQSVSSYLAWYQQKLGQAPRLLIYDASNRATGIPARFSASGSGTDFTLTISSLQPEDVATYYCQKYNSPPRTFGQGTKVEIKR |
| SEQ ID 264 | ETTLTQSPGTLSLSPGERVSLSCRASQNVYSNFLAWYQQRPGQAPSLLIYGASSRAAGVPDRFSGSGSGTDFALTISRVEPEDFAVYYCQQYGTSPITFGQGTRLEIKR |
| SEQ ID 265 | EIVLTQSPRSSPVTLGQPASISCRSSQSLEHGDGNTYLSWLQQRPGQPPRLLIYKVSNRLSGVPDRFSGSGAGTDFTLKISRVEAEDVGVYYCMQGIYWPRTFGQGTRLEIKR |
| SEQ ID 266 | ETTLTQSPVTLSLSPGDRATLSCRASQSVSSTSLAWYQHKPGQAPRLLIYGASRRATGIPDRFSGSGSGTDFTLTINRLEPEDFAVYYCQHYGSSPPITFGQGTRLEIKR |
| SEQ ID 267 | ETTLTQSPATLSVSPGERATLSCRASQSVGSKLAWYQQKPGQAPRLLIYGASTRATGVPVRFSGSGSGTEFTLTISSLQSEDFAVYYCQQYNNWPPITFGQGTRLEIKR |
| SEQ ID 268 | EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGGGTKVDIKR |
| SEQ ID 269 | DVVMTQSPDSLAVSLGERATINCKSSQSVLYSSNNKYLAWYQQKPGQPPKLLIYWASTRESGVPDRFSGSGSGTDFTLTISSLQAEDVAVYYCQQYYSSTPYTFGQGTKLEIKR |

TABLE 4-continued

VL Amino Acid Sequences

| SEQ ID | VL Amino Acid Sequence |
|---|---|
| SEQ ID 270 | DIVMTHTPLSLSVTPGQPASISCKSSQSLLGGDGKTYLYWYLQKPGQPPLLLYEVSNRFSGVPDRFSGSGAATDFTLKISRVEAEDVGVYYCMQSTQFPWTFGQGTKVEIKR |
| SEQ ID 271 | ETTLTQSPGTLSLSAGERATLSCRASQSVSSSYLAWYQQKPGQAPRLLIYAASYRATGIPDRFSGRGSGTEFTLTISSLQSEDFAVYYCQQYNNWPPITFGQGTRLEIKR |
| SEQ ID 272 | DVVMTQSPATLSVSPGERATLSCRASQSVSSNLAWYQQKPGQAPRLLIYDASTRATGIPARFSGSGSGTEFTLTISSLQSEDFAVYYCQHYNNWPHTFGQGTKLEIKR |
| SEQ ID 273 | ETTLTQSPGTLSLSPGERATLSCRASQSVSSNSLAWYQQKPGQAPRLLIYGASSRASGIPDRFNGSGSGTDFTLTINRLEPEDFAVYYCQQYGNSQTFGQGTRLEIKR |
| SEQ ID 274 | DVVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKLEIKR |
| SEQ ID 275 | DVVMTQSPLSLPVTLGQPASICRSSQSLVYSDGNTYLNWFQQRPGQSPRRLIYKVSNRDSGVPDRFSGSGSGTDFTLKISRVEAEDVGVYYCMQGTHWPRTFGGGTKLEIKR |
| SEQ ID 276 | DIQMTQSPSTLSASVGDRVTITCRASQSISRWLAWYQQKPGKAPKLLIYKASTIKSGVPSRFSASGSGTEFTLTISSLQPEDFATYYCQHYKSDSRTFGQGTKVEIKR |
| SEQ ID 277 | DVVMTQSPSSLAASVGDRITITCRPSQDIGTYLNWYQQKAGEAPKLLIYAASNLHSGVSSRFRGVGSGTQFTLTISSLQPEDFATYYCHQSYGPRTFGQGTKLEIKR |
| SEQ ID 278 | ETTLTQSPATLSVSPGERATLSCRASQSVSSNLAWYQQKPGQAPRLLIYGASTRATGIPARFSGSGSGTEFTLTISSLQSEDFAVYYCQQYNNWPPITFGQGTRLEIKR |
| SEQ ID 279 | DVVMTQSPGTLSLSPGERATLSCRASQSVSSSYLAWYQQKPGQAPRLLIYGASSRATGIPDRFSGSGSGTDFTLTISSRLEPEDFAVYYCQQYGSSGYTFGQGTKLEIKR |
| SEQ ID 280 | ETTLTQSPGTLSLSPGERATLSCRASQSVSSSYLAWYQQKPGQAPRLLIYGASSRATGIPDRFSGSGSGTDFTLTISSRLEPEDFAVYYCQQYGSSFGQGTRLEIKR |
| SEQ ID 281 | EIVLTQSPSTLSASVGDRVTITCRASQSISSCLAWYQQKPGKAPKLLIYAASTLQSGVPSRFSGSGSGTEFTLTISTLQPEDFATYYCQQLNSYPQTFGQGTKVDIKR |
| SEQ ID 282 | DIVMTHTPLSLSVTPGQPASISCKSSQSLLHSDGKTYLYWYLQKPGQPPLLIYEVSNRFSGVPDRFSGSGSGTDFTLKISRVEAEDVGVYYCMQSIQLPLTFGGGTKVEIKR |
| SEQ ID 283 | DVVMTQSPGTLSLSPGERATLSCRASQSVSSSYLAWYQQKPGQAPRLLIYGASSRATGIPDRFSGSGSGTDFTLTISSRLEPEDFAVYYCQQYNNWPLTFGGGTKLEIKR |
| SEQ ID 284 | DIQLTQSPDSLAVSLGERATINCTSSQSVLYSSNNKNYIAWYQQKPGQPPKLLIYWASTRESGVPDRFSGSGSGTDFTLTISSLQAEDVAVYYCQQYYYIPRTFGQGTKVEIKR |
| SEQ ID 285 | DVVMTQSPLSLPVTPGEPASISCRSSQSLLHSNGYNYLDWYLQKPGQSPQLLIYLGSNRAPGVPDRFSGSGSGTDFTLKISRVEAEDVGVYYCMQALQTRTFGQGTKLEIKR |
| SEQ ID 286 | ETTLTQSPGTLSLSPGERATLSCRASQSLTSSYLAWYQQKPGQAPRLLIYRASSRATGIPDRFSGSGSGTDFTLTISRLEPEDFAVYYCQQYGSSPNTFGQGTRLEIKR |
| SEQ ID 287 | EIVLTQSPLSLPVTLGQPASISCRSSQSLVHSNGHTYLSWFQQRPGQSPRRLIYEVSNRDSGVPDRFSGSGSGTDFTLRISRVEAEDVGVYYCLQGTHWPPLTVGGGTKVDIKR |
| SEQ ID 288 | DVVMTQSPATLSLSPGERATLSCRASQSVGSDLAWYQQKPGQAPRLLIYRASTRAAGIPARFSGSGSGTDFTLTISRLEPEDFAVFYCQQYGRSPYTSGQGTKLEIKR |
| SEQ ID 289 | DIVMTHTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKR |
| SEQ ID 290 | EIVMTQSPLSLSVTPGEPASISCRSSQSLLHSSGYNYLDWYLQKPGQSPQLLIYLGSTRASGVPDRFSGSGSGTDFTLKISRVEAEDVGVYYCMQGLQIPLTFGGGTKVDIKR |
| SEQ ID 291 | DIVMTHTPLSLSVTPGQPASISCKSSQSLLHSDGKTYLYWYLQKPGQPPLLIYEVSNRFSGVPDRFSGSGSGTDFTLKISRVEAEDVGVYYCMQSIQLPWTFGQGTKVEIKR |
| SEQ ID 292 | ETTLTQSPATLSVSPGERATLSCRASQSVSSNLAWYQQKPGQAPRLLIYGASTRATGIPARFSGSGSGTEFTLTISSLQSEDFAVYYCQQYNNWPRFGQGTRLEIKR |
| SEQ ID 293 | DVVMTQSPSTLSASVGDRVTITCRASQTINSWLAWYQQKPGKAPKLLISRASRLESGVPSRFSGSASGTEYILTINSLQPDDFAMYFCHQYNSYSPTFGQGTKLEIKR |
| SEQ ID 294 | ETTLTQSPGTLSLSPGERATLSCRASQSVSSSYLAWYQQKPGQAPRLLIYGASSRATGIPARFSGSGSGTDFTLTISSLEPEDFAVYYCQQRYNWPITFGQGTRLEIKR |
| SEQ ID 295 | EIVLTQSPATLSLSPGETATLSCRASQTIGPKSFGWYQQRPGQAPRLLIYDSNRATGIPARFSGSGSGTDFTLTISSLEPEDFAVYYCQQRSRWPLTFGPGTKVDIKR |
| SEQ ID 296 | DVVMTQSPLSLPVTLGQPASISCRSSQSLVYSDGNTYLYWFQQRAGQSPRRLIYKVSKRDSGVPDRFSGSGSGTDFTLKISRVEAEDVGIYYCVQGRHWPYTLGQGTKLEIKR |
| SEQ ID 297 | EIVLTQSPGTLSLSPGERATLSCRASQSVSSSYLAWYQQKPGQAPRLLIYDASNRATGIPARFSGSGSGTEFTLTISSLQPDDFATYYCQQYNSYSRTFGQGTKVDIKR |
| SEQ ID 298 | DVVMTQSPSTLSASVGDRVTITCRASQSITTWLAWSQQQPGKAPKLLIYKASSLTSGVPSRFSGSGSGTEFTLTISSLQPDDFASYYCHHYNGASRMFGQGTKLEIKR |
| SEQ ID 299 | ETTLTQSPATLSLSPGERATLSCRASQSVSSYLAWYQQKPGQAPRLLIYDASNRATGIPARFSGSGSGTDFTLTISSLEPEDFAVYYCQQRSNWPFFGQGTRLEIKR |
| SEQ ID 300 | ETTLTQSPATLTLSPGERVTLSCRASQSIGTYVAWYQQKPGQAPRFLIYDSSNRATGIPARFSGSGSGTDFTLTISSLEPEDFAFYYCQQRAEWPLTFGQGTRLEIKR |
| SEQ ID 301 | DVVMTQSPGTLSLSPGERATLSCRASQSVNSGYLAWYQQKPGQPPRLLISGVSTRATGIPDRFSGSGSGTDFTLTISRLEPEDFAVYYCQEYGNSAMYNFGQGTKLEIKR |
| SEQ ID 302 | ETTLTQSPATLSVSPGERATLSCRASQSVSSNLAWYQQKPGQAPRLLIYGASTRATGIPARFSGSGSGTEFTLTISSLQSEDFAVYYCQQYNNWPPFTFGQGTRLEIKR |
| SEQ ID 303 | DVVMTQSPGTLSLSPGERATLSCRASQSVSSSYLGWYQQKSGQAPRLLIYGASSRATGIPDRFSGSGSGTDFTLTISKLEAEDSAVYYCQQYGISPLAFGQGTKLEIKR |
| SEQ ID 304 | ETTLTQSPATLSVSPGERATLSCRASQSISNNLAWYQQKPGQAPRLLIYGTSTRATGIPARFSGSGSGTEFTLTISSLQSEDFAVYYCQQYNFWPSITFGQGTKLEIKR |
| SEQ ID 305 | ETTLTQSPGTLSLSPGERATLSCRASQSVSSSSLAWYQQKPGQAPRLLIYGASSRATGIPDRFSGSGSGTDFTLTISRLEPEDFAVYYCQQYGSSQTFGQGTRLEIKR |
| SEQ ID 306 | DVVMTQSPLSLPVSLGQPASICRSNQSLVYSDGGTYLNWFQQRAGQSPRRLVYKVSNRDSGVPDRFSGSGSGTDFTLRISRVEAEDVGVYYCMQGTHWPYTFGQGTKLEIKR |

TABLE 4-continued

VL Amino Acid Sequences

| SEQ ID | VL Amino Acid Sequence |
|---|---|
| SEQ ID 307 | DIQLTQSPSSLSASVGDRVTVTCRASQSISSYLNWYQQKPGKAPQLLIYDASNLETGVPSRFSGSGSGTDFTFTISSLQPEDFATYYCQQFDNVPVTFGGGTKVEIKR |
| SEQ ID 308 | EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKLEIKR |
| SEQ ID 309 | DVVMTQSPATLSVSPGERATLSCRASQSVSSNLAWYQQKPGQAPRLLIYGASSRATGIPDRFSGSGSGTDFTLTINRLEPEDFAVYYCQQYGSSSMYTFGQGTKLEIKR |
| SEQ ID 310 | DVVMTQSPSSLSASVGDSVAITCRASQSISNYLNWYQQRPGKAPKLLIFAASSLQSGVPSRFSGSGSGTDFTLTISSLQPEDFATYSCQQSYITPWTFGQGTKLEIKR |
| SEQ ID 311 | DVVMTQSPGTLSLSPGERATLSCRASQSVSTLLAWYQQKPGQAPRLLIYDASNRATGIPGRFSASGSGTDFSLTISSLETEDSAVYYCQHRYVWPFTFGGGTKLEIKR |
| SEQ ID 312 | DIQMTQSPSSLSASVGDRVTITCRASQGIRNDLGWYQQKPGKAPKRLIYGASSLQSGVPSRFSGSGSGTEFTLTIRSLQPEDFATYYCLQHNSYPRTFGQGTKVEIKR |
| SEQ ID 313 | DVVMTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKLEIKR |
| SEQ ID 314 | DVVMTQSPLSLPVTLGQAASISCRSSHSLTTTDGRTYVAWFQQRPGQSPRRLLYEVSKRDSGAPDRFSGSGSGTDFTLKISRVEADDVGIYHCMQGTHGPHTFGQGTKLEIKR |
| SEQ ID 315 | ETTLTQSPATLSVSPGERATLSCRASQSVTSNLAWYQQKPGQAPRLLIYGASNRATGIPARFSVSGSGTDFTLTISRLEPEDFAVYYCQQYGSPPPTTFGQGTRLEIKR |
| SEQ ID 316 | DVVMTQSPGTLSLSPGERATLSCRASQSVSSSYLAWYQQKPGQAPRLLIYGASSRATGIPDRFSGSGSGTDFTLTISRLEPEDFAVYYCQQYGSSRRTFGQGTKLEIKR |
| SEQ ID 317 | ETTLTQSPGTLSLSPGERATLSCRASQSVFNNYLAWYQQRPGQAPRLLIYGASSRATGIPDRFSGGGSGTDFTLTISRLEPEDFAVYYCCQQYGSSPITFGQGTRLEIKR |
| SEQ ID 318 | EIVLTQSPATLSLSPGERATLSCRASQSVSSYLAWYQQKPGQAPRLLIYDASNRATGIPARFSGSGSGTDFTLTISRLEPEDFAVYYCQQYGSSLRYTFGQGTKLEIKR |
| SEQ ID 319 | EIVLTQSPDSLAVSLGERATINCKSSQSVLYDSNSKNYLSWYQQKPGQPPKLLISWASTRGSGVPDRFSGSGSGTDFTLTISSLQAEDVAVYYCQQFYGIPHFGQGTRLEIKR |
| SEQ ID 320 | DVVMTQSPATLSLSPGERATLSCRASQSVGTNLAWYQQKPGQAPRLLIYDASNRATGIPARFSGSGSGTEFTLTISSLQSEDFAVYYCQQYNNWPPITFGGGTKLEIKR |
| SEQ ID 321 | DVVMTQSPLSLPVTLGQPASISCRSSQSLVYSDGNTYLSWLQQRPGQPPRLLIYKISNRFSGVPDRFSGSGAGTDFTLKISRVEAEDVGVYYCMQGTQFPQTFGQGTKLEIKR |
| SEQ ID 322 | EIVLTQSPGTLSLSPGERATLSCRASQSVISRYLAWYQQKPGQAPRLLIHGASTRATGIPDRFSGSGSGTDFTLTISRLEPEDFAVYYCQQYGSSPPYTFGQGTKVEIKR |
| SEQ ID 323 | DIQLTQSPSTLAASVGDRVTITCRASQSISSWLAWYQQKPGKAPKVLIYKASSLESGVPSRFSGSGSGTEFTLTISSLQPDDFATYYCQQYNSYSGTFGQGTKVEIKR |
| SEQ ID 324 | DVVMTQSPAILSVSPGERATLSCRASQSVSSSLAWYQQKPGQPPRLLIYGASTRATAIPARFSGSGSGTEFTLTISSLQSEDFAVYYCQRYDNWPPLFGQGTKLEIKR |

A VL amino acid sequence of the disclosure may be encoded by a polynucleotide shown in Table 5 below.

TABLE 5

VL DNA Sequences

| SEQ ID | VL DNA Sequence |
|---|---|
| SEQ ID 325 | GAAACGACACTCACGCAGTCTCCAGCCACCCTATCTGTGTCTCTAGGAGAAAGAGCCACCCTTTCTTGCAGGGCCAGTCAGAGTATTGGCAGCAACTTAGTCTGGTACCAGCTGAAACCTGGCCAGGGTCCCAGGCTCGTCATATATAGTGCAACCTCTAGGGCCACTGGAATCCCAGCCAGGTTCAGCGGCAGTGGGTCTGGGACAGAGTTCATTCTCTCCATCAGCAACCTGCAGTCTGAAGATCTTGCAGTTTATTACTGTCAGCAGTATGGTAGTTCACCTCCGACCACCTTCGGCCAAGGGACACGACTGGAGATTAAACGT |
| SEQ ID 326 | GAAATTGTGATGACACAGTCTCCAGCCACCCTGTCTTTGTCTCCAGGGGAAAGAGCCACCCTCTCCTGCAGGGCCAGTCAGAGTGTTAGCAGCAGCTACTTAGCCTGGTACCAGCAAAAACCTGGCCGGGCTCCCAGGCTCCTCATCTATGGCGCATCCAACAGGGCCACAGGCATCCCAGACAGGTTCAGTGGCAGTGGGTCTGGGACAGACTTCACTCTCATCATCAGCAGACTGGAGCCTGAAGATTTTGCCTTGTATTACTGTCAGCAGTATGGAAGCTCACCGGGAACGTTCGGCCAAGGGACCAAAGTGGATATCAAACGT |
| SEQ ID 327 | GATGTTGTGATGACTCAGTCTCCAGCCACCCTGTCTTTGTCTCCAGGGGAAAGAGCCACCCTCTCCTGCAGGGCCAGTCAGAGTGTTAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTTTATTACTGTCAGCAGCGTAGCAACTGGCCTCGGACGTTCGGCCAAGGGACCAAGCTGGAGATCAAACGT |
| SEQ ID 328 | GAAATTGTGTTGACGCAGTCTCCAGACTCCCTGGCTGTGTCTCTGGGCGAGAGGGCCACCATCACCTGCAAGTCCAGCCGGAATATTTTATACAGCGGCAACAATAAAAACTTCTTGGCTTGGTATCAGCACAAACCAGGACAGCCTCCTAAGTTGCTCATTTACTGGGCATCTACCCGGGAATCCGGGGTCCCTGACCGATTTAGTGGCAGCGGGTCTGGGACAGATTTCACCCTCACCATCAATAGCCTGGAAGCTGAAGATGCTGCAACGTATTACTGTCATCAGAGTAGTAGTTTACCTCACACTTTCGGCCCTGGGACCAAAGTGGATATCAAACGT |

TABLE 5-continued

VL DNA Sequences

| SEQ ID | VL DNA Sequence |
|---|---|
| SEQ ID 329 | GAAACGACACTCACGCAGTCTCCAGGCACCCTGTCTTTGTCTCCAGGGCAAAGAGCCACCC<br>TCTCCTGCAGGGCCAGTGAGAGTGTTAGCAAGAGCTACTTACTCTGGTACCAGCAGAAACC<br>TGGCCAGGCTCCCAGACTCCTCATCTATGGTGCATCCACCAGGGCCAGTGGCATCCCAAAC<br>AGGTTCAGTGGCAGTGGGTCTGGGACAGACTTCACTCTCACCATCAGCAGACTGGAGCCTG<br>AAGATTCTGCAGTGTATTACTGTCAGCACTATGGCAGCTCTCGCACCTTCGGCCAAGGGACA<br>CGACTGGAGATTAAACGT |
| SEQ ID 330 | GAAACGACACTCACGCAGTCTCCAGGCACCCTGTCTTTGTCTCCAGGGGAAAGAGCCACCC<br>TCTCCTGCAGGGCCAGTCAGAGTATTAGCAGCACCTACTTAGCCTGGTACCAGCAGAAACC<br>TGGCCAGGCTCCCAGGCTCCTCATCTATGGTGCATCCACCAGGGCCACTGGCATCCCAGACA<br>GGTTCAGTGGCAGTGGGTCTGGGACAGACTTCACTCTCAGCATCAGCAGACTGGAGCCTGA<br>AGATTTTGCAGTGTATTACTGTCAGCAGTATGGTAACTCACCTCCGGGAGCCACCTTCGGCC<br>AAGGGACACGACTGGAGATTAAACGT |
| SEQ ID 331 | GACATCCAGTTGACCCAGTCTCCTTCCTCCCTGTCTGCATCTGTGGGAGAAAGAGTCACCAT<br>CACTTGCCGGTCCAGCCAGGCCCTGCGAAATGTTGTCGGCCTTGGCGATGATTTAGCCTGGT<br>ATCAACACACGCCAGGCAGCGCCCCCAAGATCCTGATCTACTCTACATCGACTTTACAAAGT<br>GGAGTCTCATCAAGATTCAGCGGCGGAAAGTCTGGGAGAGACTTCACTCTCACGATCGATC<br>GTCTGCAGCCTGGAGATTCTGCAACTTATTACTGTCTCCAGCACCATGATTTCCCTTTCACTT<br>TCGGCCCTGGGACCAAGGTGGAAATCAAACGT |
| SEQ ID 332 | GATGTTGTGATGACTCAGTCTCCACTCTCCCTGCCCGTCACCCCTGGAGAGCCGGCCTCCAT<br>CTCCTGCAGGTCTAGTCAGAGCCTCCTGAATAGTAATGGATACAACTATTTGGAGTGGTACC<br>TGCAGAAGCCGGGGCAGTCTCCACAGCTCCTGATCTATTTGGGTTCTAATCGGGCCTCCGGG<br>GTCCCTGACAGGTTCAGTGGCAGTGGATCAGGCACAGATTTTACACTGAAAATCAGCAGAG<br>TGGAGGCTGACGATGCTGGTGTTTATTACTGCATGCAGTCTCTACAAACTCCTCTCACTTTC<br>GGCGGTGGGACCAAGCTGGAGATCAAACGT |
| SEQ ID 333 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTACTTAGCCTGGTACCAGCAGAAACC<br>TGGCCAGGCTCCCAGGCTCCTCATCTATGGTGCATCCAGCAGGGCCACTGGCATCCCAGAC<br>AGGTTCAGTGGCAGTGGGTCTGGGACAGACTTCACTCTCACCATCAGCAGACTGGAGCCTG<br>AAGATTTTGCAGTGTATTACTGTCAGCAGTATGGTAGCTCACCCCGGATCACCTTCGGCCAA<br>GGGACACGACTGGAGATTAAACGT |
| SEQ ID 334 | GATGTTGTGATGACTCAGTCTCCAGCCACCCTGTCTGTGTCTCCAGGGGAAAGAGCCACCCT<br>CTCCTGCAGGGCCAGTCAGAGTGTTAGCAGCAACTTAGCCTGGTACCAGCAGAAACCTGGC<br>CAGGCTCCCAGGCTCCTCATCTATGGTGCATCCACCAGGGCCACTGGTATCCCAGCCAGGTT<br>CAGTGGCAGTGGGTCTGGGACAGAGTTCACTCTCACCATCAGCAGCCTGCAGTCTGAAGAT<br>TTTGCAGTTTATTACTGTCAGCAGTATAATAACTGGCCTCCTATGTACACTTTTGGCCAGGG<br>GACCAAGCTGGAGATCAAACGT |
| SEQ ID 335 | GATGTTGTGATGACTCAGTCTCCAGCCACCCTGTCTGTGTCTCCAGGGGAAAGAGTCACACT<br>CTCCTGCAGGGCCAGTCAGAGTGTTAGAGACAACGTAGGTTGGTACAAGCAGAAACCTGGC<br>CAACCTCCCAGGCTCGTCATCTATGGTGCATCCACCAGGGCCACTGGTATCCCAGCCAGGAT<br>CAGTGGCAGTGGGTCTGGGACAGAGTTCACTCTCACCATCAGCAGCCTGCAGTCTGAAGAT<br>TTTGCAGTTTATTACTGTCAGCAGTTTAATAATTGGCCTTACACTTTTGGCCAGGGGACCAA<br>GCTGGAGATCAAACGT |
| SEQ ID 336 | GACATCCAGATGACCCAGTCTCCATCCTCCCTGTCTGCATCTGTAGGAGACAGAGTCACCAT<br>CACTTGCCGGGCAAGTCAGAGCATTAGCAGCTATTTAAATTGGTATCAGCAGAAACCAGGG<br>AAAGCCCCTAACCTCCTGATCTATGCTGCATCCAGTTTGCACACTGGGGTCCCATCAAGGTT<br>CAGTGGCAGTGGATCTGGGACAGATTTCACTCTCACCATCAGCAGTCTGCAACCTGAAGATT<br>TTGCAACTTACTACTGTCAACAGAGTTACAGTATTCCTCGAACGTTCGGCCAAGGGACCAAG<br>GTGGAAATCAAACGT |
| SEQ ID 337 | GATGTTGTGATGACTCAGTCTCCAGCCACCCTGTCTGTGACTCCAGGGGAAAGGGCCACCCT<br>CTCCTGCAGGGCCAGTCAAAGTGTTAACAGCAACGTAGCCTGGTACCAGCAGAAACCTGGC<br>CAGGCTCCCAGGCTCCTCATCTATGATGTATCCACCAGGGCCACTGATATCCCAGCCAGGTT<br>CAGTGGCAGTGGGTCTGGGACAGACTTCACTCTCACCATCAGCAGACTTGACCCTGAAGAT<br>TTTGCAGTGTATTACTGTCAGCAGTGTGCTAGCTCACCTCCTGTCACTTTCGGCGGAGGGAC<br>CAAGCTGGAGATCAAACGT |
| SEQ ID 338 | GAAATTGTGATGACGCAGTCTCCAGCCACCCTGTCTTTGTCTCCAGGGGAAAGAGCCACCCT<br>CTCCTGCGGGGCCAGTCAGAGTGTTAGCAGCAGCTACTTAGCCTGGTACCAGCAGAAACCT<br>GGCCTGGCGCCCAGGCTCCTCATCTATGATGCATCCAGCAGGGCCACTGGCATCCCAGACA<br>GGTTCAGTGGCAGTGGGTCTGGGACAGACTTCACTCTCACCATCAGCAGACTGGAGCCTGA<br>AGATTTTGCAGTGTATTACTGTCAGCAGTATGGTAGCTCACCTCGGGTCACTTTCGGCGGAG<br>GGACCAAAGTGGATATCAAACGT |
| SEQ ID 339 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCAGCAGCGCCTTAGCCTGGTTCCAGCAGAAACCT<br>GGCCAGGCTCCCAGGCTCCTCATCTATGATTCATCCAGCAGGGCCACTGGCATCCCAGACA |

TABLE 5-continued

VL DNA Sequences

| SEQ ID | VL DNA Sequence |
|---|---|
| | GCTTCAGCGGCAGTGGATCTGGGACAGAATTCACACTCACAATCAGTAGCCTGCAGCCTGA<br>AGATTTTGCAACTTATTACTGTCAACAGTTTAATACCTACCCCAACACTTTTGGCCAGGGGA<br>CCAAGCTGGAGATCAAACGT |
| SEQ ID 340 | GACATCCAGATGACCCAGTCTCCACTCTCCCTGCCCGTCACCCCTGGAGAGCCGGCCTCCAT<br>CTCCTGCAGGTCTAGTCAGAGCCTCCTGCATAGTAATGGATACAACTATTTGGATTGGTTCC<br>TGCAGAAGCCAGGGCAGTCTCCACGGCTCCTGATCTATATGGGTTCTAGTCGGGCCTCCGGG<br>GTCCCTGAGAGGTTCAGTGGCAGTGGATCAGGCACAGATTTTACACTGAAAATCAGCAGAG<br>TGGAGGCTGAGGATGTTGGGGTCTATTACTGCATGCAAACTTTACACACTGTCACTTTCGGC<br>GGCGGGACCAAGGTGGAAATCAAACGT |
| SEQ ID 341 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTACTTAGCCTGGTACCAGCAGAAACC<br>TGGCCAGGCTCCCAGGCTCCTCATCTATGGTGCATCCAGCAGGGCCACTGGCATCCCAGAC<br>AGGTTCAGTGGCAGTGGGTCTGGGACAGACTTCACTCTCACCATCAGCAGACTGGAGCCTG<br>AAGATTTTGCAGTGTATTACTGTCAGCAGTATGGTAGCTCACTCCTCTTCGGCCAAGGGACA<br>CGACTGGAGATTAAACGT |
| SEQ ID 342 | GACATCCAGTTGACCCAGTCTCCATCCTTCCTGTCTGCATCTGTTGGAGACAGAGTCACCAT<br>CACTTGCCGGGCCAGTCAGGGCATTAGCAGTTCTTTGGCCTGGTATCAGCAAAAGCCAGGG<br>AAAGCCCCTAAGCTCCTGATCTATGCTGCATCCACTTTGCAAAGTGGGGTCCCATCAAGGTT<br>CAGTGGAAGTGGATCTGGGACAGATTTTACTTTCACCATCAGCAGCCTGCAGCCTGAAGAT<br>ATTGCAACATATTACTGTCAACAGTATGATAATCTCCCTCCTCTCACTTTCGGCGGAGGGAC<br>CAAGGTGGAAATCAAACGT |
| SEQ ID 343 | GATGTTGTGATGACTCAGTCTCCACTCTCCCTGCCCGTCACCCCTGGAGAGCCGGCCTCCAT<br>CTCCTGCAGGTCTAGTCAGAGCCTCCTGCATAGTAATGGATACAACTATTTGGATTGGTACC<br>TGCAGAAGCCAGGGCAGTCTCCACAGCTCCTGATCTATTTGGGTTCTAATCGGGCCTCCGGG<br>GTCCCTGACAGGTTCAGTGGCAGTGGATCAGGCACAGATTTCACAGTGAAAATCAGCAGAG<br>TGGAGGCTGAGGATGTTGGGGTTTATTACTGCATGCAAGCTCTACAAACTCCGTACACTTTT<br>GGCCAGGGGACCAAGCTGGAGATCAAACGT |
| SEQ ID 344 | GAAATTGTGTTGACGCAGTCTCCACTCTCCCTGCCCGTCACCCTTGGACAGCCGGCCTCCAT<br>CTCCTGCAGGTCTTGTCAAAGCCTCGTATACAGTGATGGCAACACCTACTTGAATTGCTTTC<br>AGCAGAGGCCAGGCCAATCTCCAAGGCGCCTAATTTATAAGGTTTCTAACCGGGACTCTGG<br>GGTCCCAGACAGATTCAGCGGCAGTGGGTCAGGCACAGATTTTACACTGGAAATCAGCAGA<br>GTGGAGGCTGAGGATGTTGGGATTTATTTCTGCATGCAAGGTCTACAAACTCCATTCACTTT<br>CGGCCCTGGGACCAAAGTGGATATCAAACGT |
| SEQ ID 345 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCAGCAGCTACTTAGCCTGGTACCAGCAGAAACCT<br>GGCCAGGCTCCCAGGCTCCTCATCTATGGTGCATCCAGCAGGGCCACTGGCATCCCAGACA<br>GGTTCAGTGGCAGTGGGTCTGGGACAGACTTCACTCTCACCATCAGCAGACTGGAGCCTGA<br>AGATTTTGCAGTGTATTACTGTCAGCAGTATGGTAGCTCACCTGCGCTCACTTTCGGCGGAG<br>GGACCAAGCTGGAGATCAAACGT |
| SEQ ID 346 | GAAATTGTGATGACGCAGTCTCCACTCTCCCTGCCCGTCACCCCTGGAGAGCCGGCCTCCAT<br>CTCCTGCAGGTCTAGTCAGAGCCTCCTGCATAGTAATGGATACAACTATTTGGATTGGTACC<br>TGCAGAAGCCAGGGCAGTCTCCACAGCTCCTGATCTATTTGTACTCGGGCCTCCGGG<br>GTCCCTGACAGGTTCAGTGGCAGTGGATCAGGCACAGACTTTACACTGAAAATCAGCAGAG<br>CGGAGGCTGAGGATGTTGGGGTTTATTACTGCATGCAAGCTCTACACACTCCGTGGACGTTC<br>GGCCTAGGGACCAAAGTGGATATCAAACGT |
| SEQ ID 347 | GACATCCAGATGACCCAGTCTCCAGCCACCCTGTCTGTGTCTCCAGGGGAAAGGGCCACCC<br>TCTTTTGCCGGGCCAGTGAAGGTCTTACCACCAACTTAGCCTGGTACCAGCACAAACCTGGC<br>CAGGCTCCCAGGCTCCTCATCTATGCTGCCTCCACCAGGGCCACTGGTGTCCCAGCCAGGTT<br>CAGTGGCAGTGGGTCTGGGACAGACTTCACTCTCACCATCAGCAGCCTGCAGTCTGAAGAT<br>TCCGCAGTTTATTACTGTCAGCAGTATAATCACTGGCCTCTCTACACTTTTGGCCAGGGGAC<br>CAAGGTGGAAATCAAACGT |
| SEQ ID 348 | GACATCCAGTTGACCCAGTCTCCTTCCACCCTGTCTTTGTCTCCAGGGGAAAGAGCCACCCT<br>CTCCTGCAGGGCCAGTCAGAGTGTTAGCAGCTACTTAGCCTGGTACCAACAGAAATCTGGC<br>CAGGCTCCCAGGCTCCTCATCTATGATGCATCCAACAGGGCCACTGGCATCCCAGCCAGGTT<br>CAGTGGCAGTGGGTCTGGGACAGACTTCACTCTCACCATCAGCAGCCTAGAGCCTGAAGAT<br>TTTGCAGTTTATTACTGTCAGCAGGGTAGCAACTGGCCGCTCACTTTCGGCGGAGGGACCAA<br>GGTGGAAATCAAACGT |
| SEQ ID 349 | GATATTGTGATGACCCACACTCCACTCTCCTCACCTGTCACCCTTGGACAGCCGGCCTCCAT<br>CTCCTGCAGGTCTAGTCAAAGCCTCGAACACACTGATGGAAACACCTACTTAAGTTGGCTTC<br>ACCAGAGGCCAGGCCAGCCCCCAAGACTGTTAATTTATAAGGTTTCTACCCGGTTCTCTGGG<br>GTCCCAGACAGATTCAGTGGCAGTGGGCAGGGACAGATTTCACACTGAAATCAGCGGG<br>TGGAGGCTGAGGATGTCGCGTTTATTACTGCGTGCAGGCTACACACTATCCTCGGACGTTC<br>GGCCATGGGACCAAGGTGGAGATCAAACGT |

TABLE 5-continued

VL DNA Sequences

| SEQ ID | VL DNA Sequence |
|---|---|
| SEQ ID 350 | GAAATTGTGCTGACTCAGTCTCCAGGCACCCTGTCCTTGTCTCCAGGGGAAAGAGCCACCCT CTCCTGCAGGGCCAGTCAGAGTATTAGCGGCAGTTACTTAGCCTGGTACCAGCAGAAACGT GGCCAGGCTCCCAGGCTCCTCATCTATGATGCGTCCAGCAGGGCCGAAGGCATCCCAGACA GGTTCATTGGCAGTGGGTCTGGGACAGACTTCACTCTCACCATCAGCAGACTGGAGCCTGA AGACTTTGCTATGTATTACTGTCAGCAGTATGGTAGCTCACCAATATTCACTTTCGGCCCTG GGACCAAAGTGGATATCAAACGT |
| SEQ ID 351 | GAAATTGTGCTGACTCAGTCTCCAGACTCCCTGCCCGTCACCCCTGGAGAGCCGGCCTCCAT CTCCTGCAGGTCTAGTCAGAGCCTCCTGCATAGTAATGGAAACAACTATTTGGATTGGTACC TGCAGAAGCCAGGGCAGTCTCCACAGCTCCTGATCTATTTGGGTTCTAATCGGGCCTCCGGG GTCCCTGACAGGTTCAGTGGCAGTGGATCAGGCACAGATTTTACACTGAAACTCAGCAGAG TGGAGGCTGAGGATGTTGGGGTTTATTACTGCATGCAAGGTCTACAAATCCCTATCACTTTC GGCCCTGGGACCAAAGTGGATATCAAACGT |
| SEQ ID 352 | GACATCCAGATGACCCAGTCTCCATCTTCTGTGTCTGCATCTGTGGGAGACAGAGTCACCAT CACTTGTCGGGCGAGTCAGAACATTCGCCACTGGTTAGTCTGGTATCAGCAAAAATTAGGG CAAGCCCCTAAACTCCTGATCTATGCTGCGTCCAATTTGCAAAGTGGGGTCCCGTCAAGGTT CAGCGGCAGTGGATCTGGGACAGAATTCACTCTCACAATCAACAGCCTGCAGGCTGAAGAT TTTGCAACCTATTACTGTCTACAGCATAACAGTTACCCGTGGACGTTCGGCCAAGGGACCAA GGTGGAAATCAAACGT |
| SEQ ID 353 | GAAATTGTGTTGACGCAGTCTCCAGACTTTCAGTCTGTGACTCCAAAGCAGAAAGTCACCAT CACCTGCCGGGCCAGTCAGAGCATTGGTGGTAGCTTACACTGGTACCAGCAGAAACCAGGT CAGTCTCCAAAGCTCATCATCAAGTATGCTTCCCAGTCCTTCTCAGGGGTCCCCTCGAGGTT CAGTGGCAGTGGATCTGGGACAGATTTCACCCTCACCATCGATAGCCTGGAGGCTGAAGAT GCTGCAACGTACTATTGTCATCAGAGTATCAGTTTACCGCTCACTTTCGGCGGAGGGACCAA AGTGGATATCAAACGT |
| SEQ ID 354 | GAAACGACACTCACGCAGTCTCCAGGCACCCTGTCTTTGTCTCCAGGGGAAGGAGCCACCC TCTCCTGCAGGGCCAGTCAGAGTGTTACCAGCAACTACTTAGCCTGGTACCAGCAGAAACC TGGCCAGGCTCCCAGGCTCCTCATCTATGGTGCATCCTACAGGGCACTGGCATCCCTGACA GGTTCAGCGGCAGTGGGTCTGGGACAGACTTCACTCTCACCATCAGCAGACTGGAGCCTGA AGATTTTGCAGTGTATTACTGTCAGCAGTATGCTAGCTCAGTCACCTTCGGCCAAGGGACAC GACTGGAGATTAAACGT |
| SEQ ID 355 | GATGTTGTGATGACTCAGTCTCCAGCCACCCTGTCTGTGTCTCCAGGGGAAAGAGCCACCCT CTCCTGCAGGGCCAGTCAGAGTATTAGCAGCAACTTAGCCTGGTACCAGCAGAAACCTGGC CAGGCTCCCAGGCTCCTCATCTATGGTGCCTCCACCAGGGCCACTGGTATCCCAGCCAGGTT CAGTGGCAGTGGGTCTGGGACAGAGTTCACTCTCACCATCAGCAGCCTGCAGTCTGAAGAT TTTGCAGTTTATTACTGTCAGCAGTATAATAACTGGCCTAGAACGTTCGGCCAAGGGACCAA GCTGGAGATCAAACGT |
| SEQ ID 356 | GACATCCAGTTGACCCAGTCTCCAGACTCCCTGGCTGTGTCTCTGGGCGAGAGGGCCACCAT CAACTGCAAGTCCAGCCAGAGTGTTTTATACAGCTCCAACAATAAGAACTACTTAGCTTGGT ACCAGCAGAAACCAGGACAGCCTCCTAAGCTGCTCATTTACTGGGCATCTGCCCGGGAATC CGGGGTCCCTGACCGATTCAGTGGCAGCGGGTCTGGGACAGATTTCACTCTCACCATCAAC AGCCTGCAGGCTGAAGATGTGGCAGTTTATTACTGTCAGCAATTTTATAGTCCTCCTCGGAC GTTCGGCCAAGGGACCAAGGTGGAAATCAAACGT |
| SEQ ID 357 | GAAATTGTGTTGACACAGTCTCCAGGCACCCTGTCTTTGTCTCCAGGGGAAAGAGCCACCCT CTCCTGCAGGGCCAGTCAGAGTGTTAGCAGCAGCTACTTAGCCTGGTACCAGCAGAAACCT GGCCAGGCTCCCAGGCTCCTCATCTATGGTGCATCCAGCAGGGCCACTGGCATCCCAGACA GGTTCAGTGGCAGTGGGTCTGGGACAGACTTCACTCTCACCATCAGCAGACTGGAGCCTGA AGATTTTGCAGTGTATTACTGTCAGCAGTATGGTAGCTCACCCCCGGGCACTTTCGGCGGAG GGACCAAAGTGGATATCAAACGT |
| SEQ ID 358 | GAAATTGTGCTGACTCAGTCTCCAGGCACCCTGTCTTTGTCTCCAGGGGAAAGAGCCACCCT CTCCTGCAGGGCCAGTCAGAGTTTAAGTACCAACTTAGCCTGGTACCAGCAGAAACCTGGC CAGGCTCCCAGGCTCCTCATCTATGGTGCATCCACCAGGGCCACTGGTATCCCAGCCAGGTT CAGTGGCAGTGGGTCTGGCACAGAGTTCACTCTCACCATCACCAGCCTGCAGTCTGAAGATT TTGCAGTTTATTACTGTCAGCAGTATCATAACTGGCCTCCGTACACTTTTGGCCAGGGGACC AAGGTGGAGATCAAACGT |
| SEQ ID 359 | GACATCCAGATGACCCAGTCTCCTTCCACCCTGTCTGCATCTGTAGGAGACAGAGTCACCAT CACTTGCCGGGCCAGTCAGAGTATTAGTAGCTGGTTGGCCTGGTATCAGCAGAAACCAGGG AAAGCCCCTAAGCTCCTGATCTATAAGGCGTCTAGTTTAGAAAGTGGGGTCCCATCAAGGTT CAGCGGCAGTGGATCTGGGACAGAATTCACTCTCACCATCAGCAGCCTGCAGCCTGATGAT TTTGCAACTTATTACTGCCAACAGTATAATAGTTATTGGACGTTCGGCCAAGGGACCAAGGT GGAAATCAAACGT |

TABLE 5-continued

VL DNA Sequences

| SEQ ID | VL DNA Sequence |
|---|---|
| SEQ ID 360 | GAAACGACACTCACGCAGTCTCCAGGCACCCTGTCTTTGTCTCCAGGGGAAGGCGCCACCC<br>TCTCCTGCAGGGCCAGTCACAGTGTTGGCGCCAACTACATAGCCTGGTACCAGCAGAAACC<br>TGGCCAGGCTCCCAGGCTCCTTATCCATACTGCATCCAAAAGGGCCACTGGCGTCCCAGAG<br>AGGTTCAGTGGCAGTGGGTCTGGGACAGACTTCACTCTCAGTATCAGCAGACTGGAGCCTG<br>AAGACTTTGCCGTGTATCACTGTCAGCAGTATGCTGCCGCACCGATTACCTTCGGCCAAGGG<br>ACACGACTGGAGATTAAACGT |
| SEQ ID 361 | GAAATTGTGATGACACAGTCTCCATCCTCCCTGTCTGCATCTGTGGGGACAGAGTCATCAT<br>CACTTGCCGGGCGAGTCAGGGCATTGCCAATTATTTAGCCTGGTATCAGCAGAAACCAGGG<br>AAAGGTCCTAAACTCCTGATCTATGCTTCATCTACTTTGCAATCAGGGGTCCCATCTCGGTT<br>CAGTGGCAGTGGATCTGGGACAGATTTCACTCTCACCATCAGCGGCCTGCAGCCTGAAGAT<br>GTTGCAACTTATTACTGTCAGAAGTATAACAGTGTCCCTCTCACTTTCGGCGGAGGGACCAA<br>AGTGGATATCAAACGT |
| SEQ ID 362 | GATGTTGTGATGACTCAGTCTCCAGTCTCCCTGGCTGTGTCTCTGGGCGAGAGGGCCACCAT<br>CAACTGCAAGTCCAGCCAGAGTGTTTTATACAGAACCAACAATAAGAACTACTTGGCTTGG<br>TATCAGCAGAAACCAGGACAGCCTCCTAAGTTGCTCATTTACTGGGCATCTACCCGGGAATC<br>CGGGGTCCCTGACCGATTCAGTGGCAGCGGGTCTGGGACAGATTTCACTCTCACCATCAGC<br>AGCCTGCAGCCTGAGGATGTGGCAGTGTACTACTGTCAGCAATATTACAATCTTCCTCGATC<br>TTTTTGGCCAGGGGACCAAGCTGGAGATCAAACGT |
| SEQ ID 363 | GATATTGTGATGACCCACACTCCAGACTCCCTGGCTGTGTCTCTGGGCGAGAGGGCCACCAT<br>CAACTGCAAGTCCAACCGGAGTGTTTTATACAGCCCCAACAATCAGAACTACTTAGGTTGGT<br>ACCAGCAGAAGCCAGGACAGCCTCCTAAGCTGCTCATTTACTGGGCATCTACCCGGGACTC<br>CGGGGCCCCTGACCGATTCAGTGGCAGCGGGTCTGGGACAGATTTCACTCTCACCATCAAC<br>AGCCTGCAGGCTGAAGATGTGGCAGTTTATTACTGTCAGCAATATGCAAGTACTCCATACAC<br>TTTTGGCCAGGGGACCAAGGTGGAGATCAAACGT |
| SEQ ID 364 | GATGTTGTGATGACTCAGTCTCCAGCCACCCTGTCTTTGTCTCCAGGGGAAAGAGCCACCCT<br>CTCCTGCAGGGCCAGTGAGAGTGTTAATAGCAACTTCTTAGCCTGGTACCAGCAGAAACCT<br>GGCCAGGCTCCCAGGCTCCTCATCTATGCTGCATCCACCAGGGCCACTGGTATCCCAGCCAG<br>GTTCAGTGGCAGTGGGTCTGGGACAGAGTTCACTCTCATCATCACCAGCCTGCAGTCTGAAG<br>ATTTTGCAGTTTATTACTGTCAGCAGTATAATAACTGGCCGCTCACTTTCGGCGGAGGGACC<br>AAGCTGGAGATCAAACGT |
| SEQ ID 365 | GATGTTGTGATGACTCAGTCTCCAGCCACCCTGTCTTTGTCTCCAGGGGAAAGAGCCACCCT<br>CTCCTGCAGGGCCAGTCAGAGTGTTAGCAGCTACTTAGCCTGGTACCAACAGAAACCTGGC<br>CAGGCTCCCAGGCTCCTCATCTATGATGCATCCAACAGGGCCACTGGCATCCCAGCCAGGTT<br>CAGTGGCAGTGGGTCTGGGACAGACTTCACTCTCACCATCAGCAGCCTAGAGCCTGAAGAT<br>TTTGCAGTTTATTACTGTCAGCAGCGTAGCAACTGGTCGCTCACTTTCGGCGGAGGGACCAA<br>GCTGGAGATCAAACGT |
| SEQ ID 366 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTACTTAGCCTGGTACCAACAGAAACC<br>TGGCCAGGCTCCCAGGCTCCTCATCTATGGTGCTTCCACCAGGGCCACTGGCATCCCAGACA<br>GGTTCAGTGGCAGTGGGTCTGGGACGGACTTCACTCTCACCATCGGCAGACTGGAGCCTGA<br>AGATTTTGCAGTGTATTACTGTCAACACTATGGTCCCTCACGTCGGATCACCTTCGGCCAAG<br>GGACACGACTGGAGATTAAACGT |
| SEQ ID 367 | GAAACGACACTCACGCAGTCTCCAGACACCCTGTCTGTGTCTCCAGGGGGAAGAGCCACCC<br>TCTCCTGTAGGGCCAGTCAGAGCATTGGGAGCAATTTAGCCTGGTACCAACAGAAACCTGG<br>CCAGTCTCCCAGGCTCCTCATCTATGATGCATCCACCAGGGCACGGGAATCCCAGCCAGGT<br>TCAGTGGCAGTGGGTCTGGGACAGAATTCACTCTCACCATCAGCAGCCTGGAGTCTGAAGA<br>TTTTGTACTTTATTACTGTCAGCAGCATGGTGAATGGCCCACCTTCGGCCAAGGGACACGAC<br>TGGAGATTAAACGT |
| SEQ ID 368 | GATGTTGTGATGACTCAGTCTCCAGCCACCCTGTCTTTGTCTCCAGGGGAAAGAGCCACCCT<br>CTCCTGCAGGGCCAGTCAGAGTGTCGGTAACTCCTTAGCCTGGTACCAGCAGAAGCCTGGC<br>CAGGCTCCCCGGCTCCTCATCTATGATGCATCCAACAGGGCCACTGGCATCCCAGCCCGGTT<br>CAGTGGCAGTGGGTCTGGGACAGACTTCACTCTCACCATCACCAGCCTAGAGCCTGAAGAT<br>TTTGCAATTTATTACTGTCAACAACGTGGCACCTGGCCTCCCCTCACTTTCGGCGGAGGGAC<br>CAAGCTGGAGATCAAACGT |
| SEQ ID 369 | GATGTTGTGATGACTCAGTCTCCATCCTCCCTGTCTGCATCTGTAGGAGACACAGTCACCAT<br>CACTTGCCGGGCCAGTCAGAGTATAACTAACTGGTTGGCCTGGTATCAGCAGAAACCAGGG<br>AAAGCCCCCAAGCGCCTGATCTATGGTGCGTCCAGTTTGCAGAGTGGGGTCCCATCAAGGT<br>TCAGCGGCAGTGGATCTGGGACAGAATTCACTCTCACAATCAGCAGCCTGCAGCCTGAAGA<br>TTTTGCAACTTATTACTGTCAACAGTATACTAATTACCCTCGTACGTTCGGCCAAGGGACCA<br>AGCTGGAGATCAAACGT |

TABLE 5-continued

VL DNA Sequences

| SEQ ID | VL DNA Sequence |
|---|---|
| SEQ ID 370 | GACATCCAGATGACCCAGTCTCCTTCCACCCTGTCTGCATCTGTAGGAGACAGAGTCACCAT CACTTGTCGGGCCAGGCAGAGCATCAGTAACCGGTTGGCCTGGTATCAGCAGAAACCAGGG AGAGCCCCTAATGTCCTGATCTATAAGGCGTCTACTTTAGCAAATGGGGTCCCATCAAGGTT CAGCGGCAGTGGATCTGGGACAGAATTCACTCTCACCATCAGCAGCCTGCAGCCTGATGAC TTTGCAACTTATTACTGCCAACAGTATCAAAGTTACTGGACGTTCGGCCCAGGGACCAAGGT GGAAATCAAACGT |
| SEQ ID 371 | GACATCCAGTTGACCCAGTCTCCAGCCACCCTGTCTTTGTCTCCAGGGGAAAGAGCCACCCT CTCCTGCAAGGCCAGTCAGAGTGTTAGTAGCTACTTAGCCTGGTACCAACAGAAACTTGGC CAGGCTCCCAGGCTCCTCATCTATGATGCATCCAACAGGGCCACTGGCATCCCAGCCAGGTT CAGTGCCAGTGGGTCTGGGACAGACTTCACTCTCACCATCAGCAGCCTGCAGCCTGAAGAT GTTGCAACTTATTACTGTCAAAAGTATAACAGTCCCCCTCGGACGTTCGGCCAGGGGACCA AGGTGGAAATCAAACGT |
| SEQ ID 372 | GAAACGACACTCACGCAGTCTCCAGGCACCCTGTCTTTGTCTCCAGGGGAAAGGGTCAGCC TTTCCTGCAGGGCCAGTCAGAATGTTTACAGCAATTTCTTAGCCTGGTATCAACAGAGACCT GGCCAGGCTCCCAGTCTCCTCATCTATGGTGCCTCCAGCAGGGCCGCTGGCGTCCCAGACAG GTTCAGTGGCAGTGGGTCTGGGACAGACTTCGCTCTCACCATCAGCAGAGTGGAGCCTGAA GATTTTGCAGTCTATTACTGTCAACAATATGGAACCTCACCGATCACCTTCGGCCAAGGGAC ACGACTGGAGATTAAACGT |
| SEQ ID 373 | GAAATTGTGCTGACTCAGTCTCCACGCTCCTCACCCGTCACCCTTGGACAGCCGGCCTCCAT CTCCTGTAGGTCTAGTCAAAGTCTCGAACACGGTGATGGAAACACGTACTTGAGTTGGCTTC AGCAGAGGCCAGGCCAGCCTCCAAGACTCCTGATTTATAAGGTTTCTAACCGGTTGTCTGGG GTCCCAGACAGATTCAGTGGCAGTGGGGCAGGGACTGATTTCACACTGAAAATCAGCAGGG TGGAAGCTGAGGATGTCGGGGTTTATTACTGCATGCAAGGTATATACTGGCCTCGAACCTTC GGCCAAGGGACACGACTGGAGATTAAACGT |
| SEQ ID 374 | GAAACGACACTCACGCAGTCTCCAGTCACCCTGTCTTTGTCTCCAGGGGACAGAGCCACCCT CTCTTGCAGGGCCAGTCAGAGTGTTAGCAGCACCTCCTTAGCCTGGTACCAGCACAAACCTG GCCAGGCTCCCAGGCTCCTCATCTATGGTGCATCCAGGAGGGCCACTGGCATCCCAGACAG GTTCAGTGGCAGTGGGTCTGGGACAGACTTCACTCTCACCATCAACAGACTGGAGCCTGAA GATTTTGCAGTGTATTACTGTCAGCACTATGGTAGTTCACCTCCAATCACCTTCGGCCAAGG GACACGACTGGAGATTAAACGT |
| SEQ ID 375 | GAAACGACACTCACGCAGTCTCCAGCCACCCTGTCTGTGTCTCCAGGGGAAAGAGCCACCC TCTCCTGCAGGGCCAGTCAGAGTGTTGGCAGCAAATTAGCCTGGTACCAGCAGAAACCTGG CCAGGCTCCCAGGCTCCTCATCTATGGTGCATCCACCAGGGCCACTGGTGTCCCAGTCCGGT TCAGTGGCAGTGGGTCTGGGACAGAATTCACTCTCACCATCAGCAGCCTGCAGTCTGAAGA TTTTGCAGTTTATTACTGTCAGCAGTATAATAACTGGCCCCCGATCACCTTCGGCCAAGGGA CACGACTGGAGATTAAACGT |
| SEQ ID 376 | GAAATTGTGTTGACGCAGTCTCCACTCTCCCTGCCCGTCACCCCTGGAGAGCCGGCCTCCAT CTCCTGCAGGTCTAGTCAGAGCCTCCTGCATAGTAATGGATACAACTATTTGGATTGGTACC TGCAGAAGCCAGGGCAGTCTCCACAGCTCCTGATCTATTTGGGTTCTAATCGGGCCTCCGGG GTCCCTGACAGGTTCAGTGGCAGTGGATCAGGCACAGATTTTACACTGAAAATCAGCAGAG TGGAGGCTGAGGATGTTGGGGTGTATTACTGCATGCAAACTCTTCAAACTCCGCTCACTTTC GGCGGAGGGACCAAAGTGGATATCAAACGT |
| SEQ ID 377 | GATGTTGTGATGACTCAGTCTCCAGACTCCCTGGCTGTGTCTCTGGGCGAGAGGGCCACCAT CAACTGCAAGTCCAGCCAGAGTGTTTTATACAGCTCCAACAATAAGAACTACTTAGCTTGGT ACCAGCAGAAACCAGGACAGCCTCCTAAGCTGCTCATTTACTGGGCATCTACCCGGGAATC CGGGGTCCCTGACCGATTCAGTGGCAGCGGGTCTGGGACAGATTTCACTCTCACCATCAGC AGCCTGCAGGCTGAAGATGTGGCAGTTTATTACTGTCAGCAATATTATAGTAGTACTCCGTA CACTTTTGGCCAGGGGACCAAGCTGGAGATCAAACGT |
| SEQ ID 378 | GATATTGTGATGACCCACACTCCCCTCTCTCTGTCCGTCACCCCTGGACAGCCGGCCTCCAT CTCCTGCAAGTCTAGTCAGAGCCTCCTGGGTGTGATGGAAAGACCTATTTGTATTGGTACC TGCAGAAGCCAGGCCAGCCTCCACAGCTCCTGCTCTATGAAGTTTCCAACCGATTCTCTGGA GTGCCAGATAGGTTCAGTGGCAGCGGGGCAGCGACAGATTTCACACTGAAAATCAGCAGGG TGGAAGCTGAGGATGTCGGGGTTTATTACTGCATGCAATCTACACAATTTCCGTGGACGTTC GGCCAAGGGACCAAGGTGGAGATCAAACGT |
| SEQ ID 379 | GAAACGACACTCACGCAGTCTCCAGGCACCCTGTCTTTGTCTGCAGGGGAAAGAGCCACCC TCCTCTGCAGGGCCAGTCAGAGTGTTAGCAGCAGCTACTTAGCCTGGTACCAGCAGAAACC TGGCCAGGCTCCCAGGCTCCTCATCTATGCTGCATCCTACAGGGCCACTGGCATCCCAGACA GGTTCAGTGGCCGTGGGTCTGGGACAGAGTTCACTCTCACCATCAGCAGCCTGCAGTCTGA AGATTTTGCAGTTTATTACTGTCAGCAGTATAATAACTGGCCTCCCATCACCTTCGGCCAAG GGACACGACTGGAGATTAAACGT |

TABLE 5-continued

VL DNA Sequences

| SEQ ID | VL DNA Sequence |
|---|---|
| SEQ ID 380 | GATGTTGTGATGACTCAGTCTCCAGCCACCCTGTCTGTGTCTCCAGGGGAAAGAGCCACCCT<br>CTCCTGCAGGGCCAGTCAGAGTGTTAGCAGCAACTTAGCCTGGTACCAGCAGAAACCTGGC<br>CAGGCTCCCAGGCTCCTCATCTATGATGCATCCACCAGGGCCACTGGTATCCCAGCCAGGTT<br>CAGTGGCAGTGGGTCTGGGACAGAGTTCACTCTCACCATCAGCAGCCTGCAGTCTGAAGAT<br>TTTGCAGTTTATTACTGTCAGCACTATAATAACTGGCCTCATACCTTCGGCCAAGGGACCAA<br>GCTGGAGATCAAACGT |
| SEQ ID 381 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAACTCCTTAGCCTGGTACCAGCAGAAACC<br>TGGCCAGGCTCCCAGGCTCCTCATCTATGGTGCATCCAGCAGGGCCTCTGGCATCCCAGACA<br>GGTTCAATGGCAGTGGGTCTGGGACAGACTTCACTCTCACCATCAATAGGCTGGAGCCTGA<br>AGACTTTGCAGTGTATTACTGTCAGCAGTATGGTAACTCACAGACCTTCGGCCAAGGGACA<br>CGACTGGAGATTAAACGT |
| SEQ ID 382 | GATGTTGTGATGACTCAGTCTCCAGCCACCCTGTCTGTGTCTCCAGGGGAAAGAGCCACCCT<br>CTCCTGCAGGGCCAGTCAGAGTGTTAGCAGCAACTTAGCCTGGTACCAGCAGAAACCTGGC<br>CAGGCTCCCAGGCTCCTCATCTATGGTGCATCCACCAGGGCCACTGGTATCCCAGCCAGGTT<br>CAGTGGCAGTGGGTCTGGGACAGAGTTCACTCTCACCATCAGCAGCCTGCAGTCTGAAGAT<br>TTTGCAGTTTATTACTGTCAGCAGTATAATAACTGGCCCCGGACGTTCGGCCAAGGGACCAA<br>GCTGGAGATCAAACGT |
| SEQ ID 383 | GATGTTGTGATGACTCAGTCTCCACTCTCCCTGCCCGTCACCCTTGGACAGCCGGCCTCCAT<br>CTCCTGCAGGTCTAGTCAAAGCCTCGTATACAGTGATGGAAACACCTACTTGAATTGGTTTC<br>AGCAGAGGCCAGGCCAATCTCCAAGGCGCCTAATTTATAAGGTTTCTAACCGGGACTCTGG<br>GGTCCCAGACAGATTCAGCGGCAGTGGGTCAGGCACTGATTTCACACTGAAAATCAGCAGG<br>GTGGAGGCTGAGGATGTTGGGGTTTATTACTGCATGCAAGGTACACATTGGCCTCGGACTTT<br>CGGCGGAGGGACCAAGCTGGAGATCAAACGT |
| SEQ ID 384 | GACATCCAGATGACCCAGTCTCCTTCCACCCTGTCTGCATCTGTAGGAGACAGAGTCACCAT<br>CACTTGCCGGGCCAGTCAGAGTATTAGTAGGTGGTTGGCCTGGTATCAGCAGAAGCCAGGG<br>AAAGCCCCTAAGCTCCTGATCTATAAGGCGTCTACTATAAAAAGTGGGGTCCCATCAAGAT<br>TCAGCCGCAGTGGATCTGGGACAGAATTCACTCTCACCATCAGCAGCCTGCAGCCTGAAGA<br>TTTTGCAACTTATTACTGCCAACACTATAAAAGTGATTCCCGGACGTTCGGCCAAGGGACCA<br>AGGTGGAAATCAAACGT |
| SEQ ID 385 | GATGTTGTGATGACTCAGTCTCCATCCTCCCTCGCTGCATCTGTTGGAGACAGAATTACCAT<br>CACTTGCCGGCCAAGTCAGGACATAGGCACTTATTTAAATTGGTATCAACAGAAGGCAGGG<br>GAAGCCCCTAAGCTCCTCATCTATGCTGCCTCCAATCTGCACAGTGGCGTCTCATCAAGGTT<br>CAGAGGCGTTGGGTCTGGGACACAATTCACTCTCACCATCAGCAGTCTGCAACCTGAGGAT<br>TTTGCAACTTACTACTGTCATCAGAGTTACGGTCCTCGGACATTCGGCCAAGGGACCAAGCT<br>GGAGATCAAACGT |
| SEQ ID 386 | GAAACGACACTCACGCAGTCTCCAGCCACCCTGTCTGTGTCTCCAGGGGAAAGAGCCACCC<br>TCTCCTGCAGGGCCAGTCAGAGTGTTAGCAGCAACTTAGCCTGGTACCAGCAGAAACCTGG<br>CCAGGCTCCCAGGCTCCTCATCTATGGTGCATCCACCAGGGCCACTGGCATCCCAGCCAGGT<br>TCAGTGGCAGTGGGTCTGGGACAGAGTTCACTCTCACCATCAGCAGCCTGCAGTCTGAAGA<br>TTTTGCAGTTTATTACTGTCAGCAGTATAATAACTGGCCTCCGATCACCTTCGGCCAAGGGA<br>CACGACTGGAGATTAAACGT |
| SEQ ID 387 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCAGCAGCTACTTAGCCTGGTACCAGCAGAAACCT<br>GGCCAGGCTCCCAGGCTCCTCATCTATGGTGCATCCAGCAGGGCCACTGGCATCCCAGACA<br>GGTTCAGTGGCAGTGGGTCTGGGACAGACTTCACTCTCACCATCAGCAGACTGGAGCCTGA<br>AGATTTTGCAGTGTATTACTGTCAGCAGTATGGTAGCTCAGGGTACACTTTTGGCCAGGGGA<br>CCAAGCTGGAGATCAAACGT |
| SEQ ID 388 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTACTTAGCCTGGTACCAGCAGAAACC<br>TGGCCAGGCTCCCAGGCTCCTCATCTATGGTGCATCCAGCAGGGCCACTGGCATCCCAGAC<br>AGGTTCAGTGGCAGTGGGTCTGGGACAGACTTCACTCTCACCATCAGCAGACTGGAGCCTG<br>AAGATTTTGCAGTGTATTACTGTCAGCAGTATGGTAGCTCGTTCGGCCAAGGGACACGACTG<br>GAGATTAAACGT |
| SEQ ID 389 | GAAATTGTGTTGACACAGTCTCCTTCCACCCTGTCTGCATCTGTAGGGGACAGAGTCACCAT<br>CACTTGCCGGGCCAGTCAGAGTATTAGTAGCTGCTTGGCCTGGTATCAGCAGAAACCAGGG<br>AAAGCCCCTAAGCTCCTGATCTATGCTGCATCCACTTTGCAAAGTGGGGTCCCATCAAGGTT<br>CAGCGGCAGTGGATCTGGGACAGAATTCACTCTCACAATCAGCACCCTGCAGCCTGAAGAT<br>TTTGCAACTTATTACTGTCAACAGCTTAATAGTTACCCTCAGACGTTCGGCCAAGGGACCAA<br>AGTGGATATCAAACGT |

TABLE 5-continued

VL DNA Sequences

| SEQ ID | VL DNA Sequence |
|---|---|
| SEQ ID 390 | GATATTGTGATGACCCACACTCCACTCTCTCTGTCCGTCACCCCTGGACAGCCGGCCTCCAT<br>CTCCTGCAAGTCTAGTCAGAGCCTCCTGCATAGTGATGGAAAGACCTATTTGTATTGGTACC<br>TGCAGAAGCCAGGCCAGCCTCCACAGCTCCTGATCTATGAAGTTTCCAACCGGTTCTCTGGA<br>GTGCCAGATAGGTTCAGTGGCAGCGGGTCAGGGACAGATTTCACACTGAAAATCAGCCGGG<br>TGGAGGCTGAGGATGTTGGGGTTTATTACTGCATGCAAAGTATACAGCTTCCGCTCACTTTC<br>GGCGGAGGGACCAAGGTGGAGATCAAACGT |
| SEQ ID 391 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCAGCAGCTACTTAGCCTGGTACCAGCAGAAACCT<br>GGCCAGGCTCCCAGGCTCCTCATCTATGGTGCATCCAGCAGGGCCACTGGCATCCCAGACA<br>GGTTCAGTGGCAGTGGGTCTGGGACAGACTTCACTCTCACCATCAGCAGACTGGAGCCTGA<br>AGATTTTGCAGTGTATTACTGTCAGCAGTATAATAACTGGCCTCTCACTTTCGGCGGAGGGA<br>CCAAGCTGGAGATCAAACGT |
| SEQ ID 392 | GACATCCAGTTGACCCAGTCTCCCGACTCCCTGGCTGTGTCTCTGGGCGAGAGGGCCACCAT<br>CAACTGCACGTCCAGCCAGAGTGTTTTATACAGCTCCAACAATAAGAACTACATAGCTTGGT<br>ACCAGCAGAAACCAGGACAGCCTCCTAAGCTGCTCATTTACTGGGCATCTACCCGGGAATC<br>CGGGGTCCCTGACCGATTCAGTGGCAGCGGGTCTGGGACAGATTTCACTCTCACCATCAGC<br>AGCCTGCAGGCTGAAGATGTGGCAGTTTATTACTGTCAGCAATATTATTATATTCCTCGGAC<br>GTTCGGCCAAGGGACCAAGGTGGAAATCAAACGT |
| SEQ ID 393 | GATGTTGTGATGACTCAGTCTCCACTCTCCCTGCCCGTCACCCCTGGAGAGCCGGCCTCCAT<br>CTCCTGCAGGTCTAGTCAGAGCCTCCTGCATAGTAATGGATACAACTATTTGGATTGGTACC<br>TGCAGAAGCCAGGGCAGTCTCCACAGCTCCTGATCTATTTGGGTTCTAATCGGGCCCCCGGG<br>GTCCCTGACAGGTTCAGTGGCAGTGGATCAGGCACAGATTTTACACTGAAAATCAGCAGAG<br>TGGAGGCTGAGGATGTTGGGGTTTATTACTGCATGCAAGCTCTACAAACTGGACATTCGGC<br>CAAGGGACCAAGCTGGAGATCAAACGT |
| SEQ ID 394 | GAAACGACACTCACGCAGTCTCCAGGCACCCTGTCTTTGTCTCCAGGGGAAAGAGCCACCC<br>TCTCCTGCAGGGCCAGTCAGAGTCTTACCAGCAGCTACTTAGCCTGGTACCAGCAGAAACCT<br>GGCCAGGCTCCCAGACTCCTCATCTATCGTGCATCCAGCAGGGCCACTGGCATCCCAGACC<br>GGTTCAGTGGCAGTGGGTCTGGGACAGACTTCACTCTCACCATCAGCAGACTGGAGCCTGA<br>AGATTTTGCAGTTTATTACTGTCAGCAGTATGGTAGTTCACCTAACACCTTCGGCCAAGGGA<br>CACGACTGGAGATTAAACGT |
| SEQ ID 395 | GAAATTGTGTTGACACAGTCTCCACTCTCCCTGCCCGTCACCCTTGGACAGCCGGCCTCCAT<br>CTCCTGCAGGTCTAGTCAAAGCCTCGTACACAGTAATGGACACACCTACTTGAGTTGGTTTC<br>AGCAGAGGCCAGGCCAATCTCCAAGGCGCCTCATTTATGAGGTTTCTAACCGGGACTCTGG<br>TGTCCCAGACAGATTCAGCGGCAGTGGGTCAGGCACTGATTTCACACTAAGAATCAGCAGG<br>GTGGAGGCTGAGGATGTTGGGGTTTATTACTGCTTGCAAGGAACACACTGGCCCCCCCTCAC<br>TGTCGGCGGAGGGACCAAAGTGGATATCAAACGT |
| SEQ ID 396 | GATGTTGTGATGACTCAGTCTCCAGCCACCCTGTCTTTGTCTCCAGGGGAAAGAGCCACCCT<br>CTCCTGCAGGGCCAGTCAGAGTGTTGGCAGCGACTTAGCCTGGTACCAGCAGAAACCTGGC<br>CAGGCTCCCAGGCTCCTCATCTACCGTGCATCCACCAGGGCCGCTGGTATCCCAGCCAGGTT<br>CAGTGGCAGTGGGTCTGGGACAGACTTCACTCTCACCATCAGCAGACTGGAGCCTGAAGAT<br>TTTGCAGTGTTTTACTGTCAGCAGTATGGTAGATCACCGTACACTTCTGGCCAGGGGACCAA<br>GCTGGAGATCAAACGT |
| SEQ ID 397 | GATATTGTGATGACCCACACTCCAGACTCCCTGGCTGTGTCTCTGGGCGAGAGGGCCACCAT<br>CAACTGCAAGTCCAGCCAGAGTGTTTTATACAGCTCCAACAATAAGAACTACTTAGCTTGGT<br>ACCAGCAGAAACCAGGACAGCCTCCTAAGCTGCTCATTTACTGGGCATCTACCCGGGAATC<br>CGGGGTCCCTGACCGATTCAGTGGCAGCGGGTCTGGGACAGATTTCACTCTCACCATCAGC<br>AGCCTGCAGGCTGAAGATGTGGCAGTTTATTACTGTCAGCAATATTATAGTACTCCGCTCAC<br>TTTCGGCGGAGGGACCAAGGTGGAGATCAAACGT |
| SEQ ID 398 | GAAATTGTGATGACGCAGTCTCCACTCTCCCTGTCCGTCACCCCTGGAGAGCCGGCCTCCAT<br>CTCCTGCAGGTCTAGTCAGAGCCTCCTACATAGTAGTGGATACAACTATTTGGATTGGTACC<br>TGCAGAAGCCAGGCCAGTCTCCACAGCTCCTGATCTATTTGGGTTCTACTCGGGCCTCCGGG<br>GTCCCTGACAGGTTCAGTGGCAGTGGATCAGGCACAGATTTTACACTGAAAATCAGCAGAG<br>TGGAGGCTGAGGATGTTGGGGTTTATTATTGCATGCAAGGTCTACAAATTCCGCTCACTTTC<br>GGCGGAGGGACCAAAGTGGATATCAAACGT |
| SEQ ID 399 | GATATTGTGATGACCCACACTCCACTCTCTCTGTCCGTCACCCCTGGACAGCCGGCCTCCAT<br>CTCCTGCAAGTCTAGTCAGAGCCTCCTGCATAGTGATGGAAAGACCTATTTGTATTGGTACC<br>TGCAGAAGCCAGGCCAGCCTCCACAGCTCCTGATCTATGAAGTTTCCAACCGGTTCTCTGGA<br>GTGCCAGATAGGTTCAGTGGCAGCGGGTCAGGGACAGATTTCACACTGAAAATCAGCCGGG<br>TGGAGGCTGAGGATGTTGGGGTTTATTACTGCATGCAAAGTATACAGCTTCCGTGGACGTTC<br>GGCCAAGGGACCAAGGTGGAGATCAAACGT |

TABLE 5-continued

VL DNA Sequences

| SEQ ID | VL DNA Sequence |
|---|---|
| SEQ ID 400 | GAAACGACACTCACGCAGTCTCCAGCCACCCTGTCTGTGTCTCCAGGGGAAAGAGCCACCC<br>TCTCCTGCAGGGCCAGTCAGAGTGTTAGCAGCAACTTAGCCTGGTACCAGCAGAAACCTGG<br>CCAGGCTCCCAGGCTCCTCATCTATGGTGCATCCACCAGGGCCACTGGCATCCCAGCCAGGT<br>TCAGTGGCAGTGGGTCTGGGACAGAGTTCACTCTCACCATCAGCAGCCTGCAGTCTGAAGA<br>TTTTGCAGTTTATTACTGTCAGCAGTATAATAACTGGCCTCGGTTCGGCCAAGGGACACGAC<br>TGGAGATTAAACGT |
| SEQ ID 401 | GATGTTGTGATGACTCAGTCTCCTTCCACCCTGTCTGCATCTGTAGGGGACAGAGTCACCAT<br>CACTTGCCGGGCCAGTCAGACTATTAATAGTTGGTTGGCCTGGTATCAGCAGAAACCAGGG<br>AAGGCCCCTAAGCTCCTCATCTCTAGGGCGTCTCGTTTAGAAAGTGGGGTCCCATCAAGGTT<br>CAGCGGCAGTGCATCTGGCACAGAATACATTCTCACCATCAACAGCCTGCAGCCTGATGAT<br>TTTGCAATGTACTTCTGCCATCAATATAATAGTTATTCTCCCACTTTTGGCCAGGGGACCAA<br>GCTGGAGATCAAACGT |
| SEQ ID 402 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTACTTAGCCTGGTACCAGCAGAAACC<br>TGGCCAGGCTCCCAGGCTCCTCATCTATGGTGCATCCAGCAGGGCCACTGGCATCCCAGCCA<br>GGTTCAGTGGCAGTGGGTCTGGGACAGACTTCACTCTCACCATCAGCAGCCTAGAGCCTGA<br>AGATTTTGCAGTTTATTACTGTCAGCAGCGTTACAACTGGCCTATCACCTTCGGCCAAGGGA<br>CACGACTGGAGATTAAACGT |
| SEQ ID 403 | GAAATTGTGTTGACGCAGTCTCCAGCCACCCTGTCTTTGTCTCCGGGGGAAACAGCCACCCT<br>CTCCTGCAGGGCCAGTCAGACTATTGGTCCCAAGTCCTTCGGCTGGTACCAACAGAGACCTG<br>GCCAGGCTCCCAGGCTCCTCATCTATGACTCCAACAGGGCCACTGGCATCCCAGCCAGGTTC<br>AGTGGCAGTGGGTCTGGGACAGACTTCACTCTCACCATCAGCAGCCTAGAGCCTGAAGATT<br>TTGCAGTTTATTACTGTCAGCAGCGTAGCAGGTGGCCTCTCACTTTCGGCCCTGGGACCAAA<br>GTGGATATCAAACGT |
| SEQ ID 404 | GATGTTGTGATGACTCAGTCTCCACTCTCCCTGCCCGTCACCCTTGGACAGCCGGCCTCCAT<br>CTCCTGCAGGTCTAGTCAAAGCCTCGTGTACAGTGATGGAAACACCTACTTGTATTGGTTTC<br>AGCAGAGGGCAGGCCAATCTCCAAGGCGCCTGATTTATAAGGTTTCTAAGCGGGACTCTGG<br>GGTCCCAGACAGGTTCAGCGGCAGTGGGTCAGGCACTGATTTCACACTGAAAATCAGCAGG<br>GTGGAGGCTGAGGATGTTGGAATTTATTACTGCGTGCAAGGTAGACACTGGCCGTACACTC<br>TTGGCCAGGGGACCAAGCTGGAGATCAAACGT |
| SEQ ID 405 | GAAATTGTGTTGACGCAGTCTCCAGGCACCCTGTCTTTGTCTCCAGGGGAAAGAGCCACCCT<br>CTCCTGCAGGGCCAGTCAGAGTGTTAGCAGCAGCTACTTAGCCTGGTACCAGCAGAAACCT<br>GGCCAGGCTCCCAGGCTCCTCATCTATGATGCATCCAACAGGGCCACTGGCATCCCAGCCA<br>GGTTCAGTGGCAGTGGATCTGGGACAGAATTCACTCTCACCATCAGCAGCCTGCAGCCTGA<br>TGATTTTGCAACTTATTACTGCCAACAGTATAATAGTTATTCAAGGACGTTCGGCCAGGGGA<br>CCAAAGTGGATATCAAACGT |
| SEQ ID 406 | GATGTTGTGATGACTCAGTCTCCTTCCACCCTGTCTGCATCTGTGGGAGACAGAGTCACCAT<br>CACTTGCCGGGCCAGTCAGAGTATTACTACCTGGTTGGCCTGGTCTCAGCAGCAACCAGGG<br>AAAGCCCCTAAGCTCCTCATCTATAAGGCCTCTAGTTTAACAAGTGGGGTCCCATCAAGGTT<br>CAGCGGCAGTGGATCTGGGACAGAGTTCACTCTCACCATCAGCAGCCTGCAGCCTGATGAT<br>TTTGCAAGTTATTACTGCCATCATTATAATGGTGCTTCTCGTATGTTCGGCCAAGGGACCAA<br>GCTGGAGATCAAACGT |
| SEQ ID 407 | GAAACGACACTCACGCAGTCTCCAGCCACCCTGTCTTTGTCTCCAGGGGAAAGAGCCACCC<br>TCTCCTGCAGGGCCAGTCAGAGTGTTAGCAGCTACTTAGCCTGGTACCAACAGAAACCTGG<br>CCAGGCTCCCAGGCTCCTCATCTATGATGCATCCAACAGGGCCACTGGCATCCCAGCCAGGT<br>TCAGTGGCAGTGGGTCTGGGACAGACTTCACTCTCACCATCAGCAGCCTAGAGCCTGAAGA<br>TTTTGCAGTTTATTACTGTCAGCAGCGTAGCAACTGGCCTTTCTTCGGCCAAGGGACACGAC<br>TGGAGATTAAACGT |
| SEQ ID 408 | GAAACGACACTCACGCAGTCTCCAGCCACCCTGACTTTGTCTCCAGGGGAAAGAGTCACCC<br>TCTCCTGCAGGGCCAGTCAGAGTATTGGCACTTACGTCGCCTGGTATCAGCAGAAACCTGGC<br>CAGGCTCCCAGATTCCTCATCTATGATTCATCGAATAGGGCCACTGGCATCCCAGCCAGGTT<br>CAGTGGTAGTGGGTCTGGGACAGACTTCACTCTCACGATCAGCAGCCTGGAGCCTGAAGAT<br>TTTGCATTTTATTACTGTCAACAGCGTGCCGAGTGGCCTCTCACCTTCGGCCAAGGGACACG<br>ACTGGAGATTAAACGT |
| SEQ ID 409 | GATGTTGTGATGACTCAGTCTCCAGGCACCCTGTCTTTGTCTCCAGGGGAAAGAGCCACTCT<br>CTCCTGCAGGGCCAGTCAGAGTGTTAATAGCGGCTACTTAGCCTGGTACCAGCAGAAACCT<br>GGCCAACCTCCCAGACTCCTCATCTCTGGTGTTTCCACCAGGGCCACTGGCATCCCAGACAG<br>GTTCAGTGGCAGTGGGTCTGGGACAGACTTCACTCTCACCATCAGCAGACTGGAGCCTGAA<br>GATTTTGCAGTGTATTACTGTCAGGAGTATGGTAACTCAGCTATGTACAATTTTGGCCAGGG<br>GACCAAGCTGGAGATCAAACGT |

TABLE 5-continued

VL DNA Sequences

| SEQ ID | VL DNA Sequence |
|---|---|
| SEQ ID 410 | GAAACGACACTCACGCAGTCTCCAGCCACCCTGTCTGTGTCTCCAGGGGAAAGAGCCACCC<br>TCTCCTGCAGGGCCAGTCAGAGTGTTAGCAGCAACTTAGCCTGGTACCAGCAGAAACCTGG<br>CCAGGCTCCCAGGCTCCTCATCTATGGTGCATCCACCAGGGCACTGGTATCCCAGCCAGGT<br>TCAGTGGCAGTGGGTCTGGGACAGAGTTCACTCTCACCATCAGCAGCCTGCAGTCTGAAGA<br>TTTTGCAGTTTATTACTGTCAGCAGTATAATAACTGGCCTCCCTTCACCTTCGGCCAAGGGA<br>CACGACTGGAGATTAAACGT |
| SEQ ID 411 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCAGCAGCTACTTAGGCTGGTATCAGCAGAAATCC<br>GGCCAGGCTCCCAGGCTCCTCATCTATGGTGCATCCAGCAGGGCCACTGACATCCCAGACA<br>GGTTCAGTGGCAGTGGGTCTGGGACAGACTTCACTCTCACCATCAGCAAACTGGAGGCAGA<br>AGATTCTGCAGTGTATTACTGTCAGCAGTATGGTATCTCACCTCTCGCGTTCGGCCAAGGGA<br>CCAAGCTGGAGATCAAACGT |
| SEQ ID 412 | GAAACGACACTCACGCAGTCTCCAGCCACCCTGTCTGTGTCTCCAGGGGAGAGAGCCACCC<br>TCTCCTGCAGGGCCAGTCAGAGTATTAGCAACAACTTAGCCTGGTACCAGCAGAAACCTGG<br>CCAGGCTCCCAGGCTCCTCATCTATGGTACATCCACCAGGGCACTGGTATCCCAGCCAGGT<br>TCAGTGGCAGTGGGTCTGGGACAGAGTTCACTCTCACCATCAGCAGCCTGCAGTCTGAAGA<br>TTTTGCAGTTTATTACTGTCAGCAGTATAATTTCTGGCCTTCGATCACCTTCGGCCAAGGGAC<br>ACGACTGGAGATTAAACGT |
| SEQ ID 413 | GAAACGACACTCACGCAGTCTCCAGGCACCCTGTCTTTGTCTCCAGGGGAAAGAGCCACCC<br>TCTCCTGCAGGGCCAGTCAGAGTGTTAGCAGCAGCTCCTTAGCCTGGTACCAGCAGAAACC<br>TGGCCAGGCTCCCAGGCTCCTCATCTATGGTGCATCCAGCAGGGCCACTGGCATCCCAGAC<br>AGGTTCAGTGGCAGTGGGTCTGGGACAGACTTCACTCTCACCATCAGCAGACTGGAGCCTG<br>AAGATTTTGCAGTGTATTACTGTCAGCAGTATGGTAGCTCACAGACCTTCGGCCAAGGGAC<br>ACGACTGGAGATTAAACGT |
| SEQ ID 414 | GATGTTGTGATGACTCAGTCTCCACTCTCCCTGCCCGTCTCCCTTGGACAGCCGGCCTCCATC<br>TCCTGCAGGTCTAATCAAAGCCTCGTATACAGTGATGGAGGCACCTACTTGAATTGGTTTCA<br>GCAGAGGGCAGGCCAGTCTCCAAGGCGCCTAGTTTATAAGGTTTCTAACCGGGACTCTGGG<br>GTCCCAGACAGATTCAGCGGCAGTGGGTCAGGCACTGATTTCACACTGAGAATCAGCAGGG<br>TGGAGGCTGAGGATGTTGGGGTTTATTACTGCATGCAAGGGACACACTGGCCGTACACTTTT<br>GGCCAGGGGACCAAGCTGGAGATCAAACGT |
| SEQ ID 415 | GACATCCAGTTGACCCAGTCTCCATCCTCCCTGTCTGCATCTGTAGGAGACAGAGTCACCGT<br>CACTTGCCGGGCAAGTCAGAGCATTAGCAGCTATTTAAATTGGTATCAGCAGAAACCAGGG<br>AAAGCCCCTCAACTCCTGATCTACGATGCATCCAATTTGGAAACAGGGGTCCCCTCAAGGTT<br>CAGTGGAAGTGGATCTGGGACAGATTTTACTTTCACCATCAGCAGCCTGCAGCCTGAAGATT<br>TTGCAACATATTACTGTCAGCAGTTTGATAATGTCCCAGTCACTTTCGGCGGAGGGACCAAG<br>GTGGAAATCAAACGT |
| SEQ ID 416 | GAAATTGTGCTGACTCAGTCTCCACTCTCCCTGCCCGTCACCCTTGGACAGCCGGCCTCCAT<br>CTCCTGCAGGTCTAGTCAAAGCCTCGTATACAGTGATGGAAACACCTACTTGAATTGGTTTC<br>AGCAGAGGCCAGGCCAATCTCCAAGGCGCCTAATTTATAAGGTTTCTAACCGGGACTCTGG<br>GGTCCCAGACAGATTCAGCGGCAGTGGGTCAGGCACTGATTTCACACTGAAAATCAGCAGG<br>GTGGAGGCTGAGGATGTTGGGGTTTATTACTGCATGCAAGGTACACACTGGCCTCGAACGT<br>TCGGCCAAGGGACCAAGCTGGAGATCAAACGT |
| SEQ ID 417 | GATGTTGTGATGACTCAGTCTCCAGCCACCCTGTCTGTGTCTCCAGGGGAAAGAGCCACCCT<br>CTCCTGCAGGGCCAGTCAGAGTGTTAGCAGCAACTTAGCCTGGTACCAGCAGAAACCTGGC<br>CAGGCTCCCAGGCTCCTCATCTATGGTGCATCCAGCAGGGCCACTGGCATCCCAGACAGGTT<br>CAGTGGCAGTGGGTCTGGGACAGACTTCACTCTCACCATCAACAGACTGGAGCCTGAAGAT<br>TTTGCAGTGTATTACTGTCAGCAGTATGGTAGCTCATCCATGTACACTTTTGGCCAGGGGAC<br>CAAGCTGGAGATCAAACGT |
| SEQ ID 418 | GATGTTGTGATGACTCAGTCTCCATCCTCCCTGTCTGCATCTGTGGGGACAGCGTCGCCAT<br>CACTTGCCGGGCAAGTCAGAGCATTAGCAACTATTTAAATTGGTATCAGCAGAGACCAGGG<br>AAAGCCCCTAAGCTCCTGATCTTTGCTGCATCCAGTTTGCAAAGTGGGGTCCCATCAAGGTT<br>CAGTGGCAGTGGATCTGGGACAGATTTCACTCTCACCATCAGCAGTCTGCAACCTGAAGATT<br>TTGCAACTTACTCCTGTCAACGAGTTACATTACCCCGTGGACGTTCGGCCAAGGGACCAAG<br>CTGGAGATCAAACGT |
| SEQ ID 419 | GATGTTGTGATGACTCAGTCTCCAGGCACCCTGTCTTTGTCTCCAGGGGAAAGAGCCACCCT<br>CTCCTGCAGGGCCAGTCAGAGTGTTAGCACCCTCTTAGCCTGGTACCAACAGAAACCTGGC<br>CAGGCTCCCAGGCTCCTCATCTATGATGCATCCAACAGGGCCACTGGCATCCCAGGCAGGTT<br>CAGTGCCAGTGGGTCTGGGACAGACTTCAGTCTCACCATCAGCAGCCTAGAGACTGAAGAT<br>TCTGCAGTTTATTACTGTCAGCACCGTTACGTGTGGCCGTTCACTTTCGGCGGAGGGACCAA<br>GCTGGAGATCAAACGT |

TABLE 5-continued

VL DNA Sequences

| SEQ ID | VL DNA Sequence |
|---|---|
| SEQ ID 420 | GACATCCAGATGACCCAGTCTCCATCCTCCCTGTCTGCATCTGTAGGAGACAGAGTCACCAT CACTTGCCGGGCAAGTCAGGGCATTAGAAATGATTTAGGCTGGTATCAGCAGAAACCAGGG AAAGCCCCTAAGCGTCTGATCTATGGTGCATCCAGTTTGCAAAGTGGAGTCCCATCAAGGTT CAGCGGCAGTGGATCTGGGACAGAATTCACTCTCACAATCAGGAGCCTGCAGCCTGAAGAT TTTGCAACTTATTATTGTCTACAGCATAATTCCTACCCTCGAACATTCGGCCAAGGGACCAA GGTGGAAATCAAACGT |
| SEQ ID 421 | GATGTTGTGATGACTCAGTCTCCAGCCACCCTGTCTTTGTCTCCAGGGGAAAGAGCCACCCT CTCCTGCAGGGCCAGTCAGAGTGTTAGCAGCTACTTAGCCTGGTACCAACAGAAACCTGGC CAGGCTCCCAGGCTCCTCATCTATGATGCATCCAACAGGGCCACTGGCATCCCAGCCAGGTT CAGTGGCAGTGGGTCTGGGACAGACTTCACTCTCACCATCAGCAGCCTAGAGCCTGAAGAT TTTGCAGTTTATTACTGTCAGCAGCGTAGCAACTGGCCGTGGACGTTCGGCCAAGGGACCA AGCTGGAGATCAAACGT |
| SEQ ID 422 | GATGTTGTGATGACTCAGTCTCCGCTCTCCCTGCCCGTCACCCTTGGACAGGCGGCCTCCAT CTCCTGCAGGTCTAGTCATAGCCTCACAACTACTGATGGACGTACTTACGTGGCTTGGTTTC AGCAGAGGCCAGGCCAATCTCCAAGGCGCCTTCTTTATGAGGTTTCTAAGCGGGACTCTGG GGCCCAGACAGATTCAGCGGCAGTGGGTCAGGCACTGATTTCACTCTGAAAATCAGCAGG GTGGAGGCTGACGATGTTGGAATTTATCATTGCATGCAAGGAACACATGGGCCTCACACGT TCGGCCAAGGGACCAAGCTGGAGATCAAACGT |
| SEQ ID 423 | GAAACGACACTCACGCAGTCTCCAGCCACCCTGTCTGTGTCTCCAGGGGAAAGAGCCACCC TCTCCTGCAGGGCCAGTCAAAGTGTTACCAGCAACTTAGCCTGGTACCAGCAGAAACCTGG CCAGGCTCCCAGGCTCCTCATCTATGGTGCATCCAACAGGGCCACTGGTATCCCAGCCAGGT TCAGTGTCAGTGGGTCTGGGACAGACTTCACTCTCACCATCAGCAGACTGGAGCCTGAAGA TTTTGCAGTGTATTACTGTCAGCAGTATGGTAGTCCACCTCCGACCACCTTCGGCCAAGGGA CACGACTGGAGATTAAACGT |
| SEQ ID 424 | GATGTTGTGATGACTCAGTCTCCAGGCACCCTGTCTTTGTCTCCAGGGGAAAGAGCCACCCT CTCCTGCAGGGCCAGTCAGAGTGTTAGCAGCAGCTACTTAGCCTGGTACCAGCAGAAACCT GGCCAGGCTCCCAGGCTCCTCATCTATGGTGCATCCAGCAGGGCCACTGGCATCCCAGACA GGTTCAGTGGCAGTGGGTCTGGGACAGACTTCACTCTCACCATCAGCAGACTGGAGCCTGA AGATTTTGCAGTGTATTACTGTCAGCAGTATGGTAGCTCACGTCGGACGTTCGGCCAAGGGA CCAAGCTGGAGATCAAACGT |
| SEQ ID 425 | GAAACGACACTCACGCAGTCTCCAGGCACCCTGTCCTTGTCTCCAGGGGAAAGAGCCACCC TCTCCTGCAGGGCCAGTCAGAGTGTTTTCAACAACTACTTAGCCTGGTACCAACAGAGACCT GGCCAGGCTCCCAGGCTCCTCATCTATGGTGCATCCAGCAGGGCCACTGGCATCCCAGACA GGTTCAGTGGCGGTGGGTCTGGGACAGACTTCACTCTCACCATCAGCAGACTGGAGCCTGA AGATTTCGCAGTGTATTGCTGTCAGCAGTATGGTAGTTCACCGATCACCTTCGGCCAAGGGA CACGACTGGAGATTAAACGT |
| SEQ ID 426 | GAAATTGTGCTGACTCAGTCTCCAGCCACCCTGTCTTTGTCTCCAGGGGAAAGAGCCACCCT CTCCTGCAGGGCCAGTCAGAGTGTTAGCAGCTACTTAGCCTGGTACCAACAGAAACCTGGC CAGGCTCCCAGGCTCCTCATCTATGATGCATCCAACAGGGCCACTGGCATCCCAGCCAGGTT CAGTGGCAGTGGGTCTGGGACAGACTTCACTCTCACCATCAGCAGACTGGAGCCTGAAGAT TTTGCAGTGTATTACTGTCAGCAGTATGGTAGCTCACTCAGGTACACTTTTGGCCAGGGGAC CAAGCTGGAGATCAAACGT |
| SEQ ID 427 | GAAATTGTGCTGACTCAGTCTCCAGACTCCCTGGCTGTGTCTCTGGGCGAGAGGGCCACCAT CAACTGCAAGTCCAGCCAGAGTGTTTTATATGATTCCAACAGTAAGAACTACTTAAGTTGGT ATCAGCAGAAACCAGGCCAGCCTCCTAAGTTGCTCATTTCCTGGGCGTCTACCCGGGGGTCC GGGGTCCCTGACCGATTCAGTGGCAGCGGGTCTGGGACAGATTTCACTCTCACCATCAGCA GCCTGCAGGCTGAAGATGTGGCAGTTTATTACTGTCAGCAATTTTATGGTATTCCCCACTTC GGCCAAGGGACACGACTGGAGATTAAACGT |
| SEQ ID 428 | GATGTTGTGATGACTCAGTCTCCAGCCACCCTGTCTTTGTCTCCAGGGGAAAGAGCCACCCT CTCCTGCAGGGCCAGTCAGAGTGTTGGTACCAATTTAGCCTGGTACCAGCAGAAACCTGGC CAGGCTCCCAGGCTCCTCATCTATGATGCATCCAACAGGGCCACTGGCATCCCAGCCAGGTT CAGTGGCAGTGGGTCTGGGACAGAGTTCACTCTCACCATCAGCAGCCTGCAGTCTGAAGAT TTTGCAGTTTATTACTGTCAGCAGTATAATAACTGGCCTCCGATAACTTTCGGCGGAGGGAC CAAGCTGGAGATCAAACGT |
| SEQ ID 429 | GATGTTGTGATGACTCAGTCTCCACTCTCCCTGCCCGTCACCCTTGGACAGCCGGCCTCCAT CTCCTGCAGGTCTAGTCAAAGCCTCGTATACAGTGATGGAAACACCTACTTGAGTTGGCTTC AGCAGAGGCCAGGCCAGCCTCCAAGACTCCTAATTTATAAGATTTCTAACCGGTTCTCTGGG GTCCCAGACAGATTCAGTGGCAGTGGGCAGGGACAGATTTCACACTGAAAATCAGCAGGG TGGAAGCTGAGGATGTCGGGGTTTATTACTGCATGCAAGGTACACAATTTCCTCAAACGTTC GGCCAAGGGACCAAGCTGGAGATCAAACGT |

TABLE 5-continued

VL DNA Sequences

| SEQ ID | VL DNA Sequence |
|---|---|
| SEQ ID 430 | GAAATTGTGCTGACTCAGTCTCCAGGCACCCTGTCTTTGTCTCCAGGGGAAAGAGCCACCCT CTCCTGCAGGGCCAGTCAGAGTGTAATAAGCAGGTACTTAGCCTGGTATCAGCAGAAACCT GGCCAGGCTCCCAGGCTCCTCATCCATGGTGCATCCACCAGGGCCACTGGCATCCCAGACA GGTTCAGTGGCAGTGGGTCTGGGACAGACTTCACTCTCACCATCAGCAGACTGGAGCCTGA AGACTTTGCAGTGTATTACTGTCAGCAGTATGGTAGCTCACCTCCGTACACTTTTGGCCAGG GGACCAAGGTGGAAATCAAACGT |
| SEQ ID 431 | GACATCCAGTTGACCCAGTCTCCTTCCACCCTGGCTGCATCTGTAGGAGACAGAGTCACCAT CACTTGCCGGGCCAGTCAGAGTATTAGTAGCTGGTTGGCCTGGTATCAGCAGAAACCAGGG AAAGCCCCTAAGGTCCTGATCTATAAGGCGTCTAGTTTAGAAAGTGGGGTCCCATCAAGGT TCAGCGGCAGTGGATCTGGGACAGAATTCACTCTCACCATCAGCAGCCTGCAGCCTGATGA TTTTGCAACTTATTACTGCCAACAGTATAATAGTTATTCGGGGACGTTCGGCCAAGGGACCA AGGTGGAAATCAAACGT |
| SEQ ID 432 | GATGTTGTGATGACTCAGTCTCCAGCCATCCTGTCTGTGTCTCCAGGGGAAAGAGCCACCCT CTCCTGCAGGGCCAGTCAGAGTGTTAGTAGCAGCTTAGCCTGGTACCAGCAGAAACCTGGC CAGCCTCCCAGGCTCCTCATCTATGGTGCCTCCACCAGGGCCACTGCTATCCCAGCCAGGTT CAGTGGCAGTGGGTCTGGGACAGAGTTCACTCTCACCATCAGCAGCCTGCAGTCTGAAGAT TTTGCAGTTTATTACTGTCAGCGCTATGATAACTGGCCTCCCCTTTTTGGCCAGGGGACCAA GCTGGAGATCAAACGT |

Exemplary CDR amino acid sequences of CLEC2D antibodies of the disclosure are shown in Table 6 below.

TABLE 6

CDR Amino Acid Sequences

| | VH | | | | | | VL | | | | |
|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| SEQ ID 433 | GYTFTSYAMH | SEQ ID 486 | WINAGNNTKYSQKFQG | SEQ ID 547 | GSLSRSGWYAGLFDY | SEQ ID 654 | ASQSIGSNLVW | SEQ ID 727 | SATSRATG | SEQ ID 784 | YGSSPPTTF |
| SEQ ID 434 | GFTFSSYSMN | SEQ ID 487 | IISDDGSKSYYADSVQG | SEQ ID 548 | DRGTKWNQLNDVFDM | SEQ ID 655 | ASQSVSSYLAW | SEQ ID 728 | GASNRATG | SEQ ID 785 | YGSSPGTF |
| SEQ ID 435 | GYTFTSYYMH | SEQ ID 488 | IINPSGGSTSYAQKFQG | SEQ ID 549 | GRGYSSSRLYYFDY | SEQ ID 656 | ASQSVSSYLAW | SEQ ID 729 | DASNRATG | SEQ ID 786 | RSNWPRTF |
| SEQ ID 436 | GFTFSDPYMD | SEQ ID 489 | RITNKRTGYATTYAASVKD | SEQ ID 550 | DVSGSFAAY | SEQ ID 657 | SSRNILYSGNNKNFLAW | SEQ ID 730 | WASTRESG | SEQ ID 787 | SSSLPHTF |
| SEQ ID 437 | GFTFSSYAMH | SEQ ID 490 | WINAGNNTKYSQKFQG | SEQ ID 551 | EGGAVAGTVY | SEQ ID 658 | ASESVSKSYLLW | SEQ ID 731 | GASTRASG | SEQ ID 788 | YGSSRTF |
| SEQ ID 438 | GFTFSNAWMS | SEQ ID 491 | RIKSKTDGGTTDYAAPVKG | SEQ ID 552 | DEYFY | SEQ ID 659 | ASQSISSTYLAW | SEQ ID 732 | GASTRATG | SEQ ID 789 | YGNSPPGATF |
| SEQ ID 439 | GGSFSGYYWS | SEQ ID 492 | EINHSGSTNYNPSLKS | SEQ ID 553 | VNPGSYTREVSNFDY | SEQ ID 660 | SSQALRNVVGLGDDLAW | SEQ ID 733 | STSTLQSG | SEQ ID 790 | HHDFPFTF |
| SEQ ID 440 | GDSVSSNSVTWN | SEQ ID 493 | RTYYRSQWYYNYAVSVKS | SEQ ID 554 | RGHNYGVDY | SEQ ID 661 | SSQSLLNSNGYNYLEW | SEQ ID 734 | LGSNRASG | SEQ ID 791 | SLQTPLTF |
| SEQ ID 441 | GYTFAAYYLH | SEQ ID 494 | RIKSKTDGETTDYAAPVKG | SEQ ID 555 | GVGWSPFQY | SEQ ID 662 | ASQSVSSNLAW | SEQ ID 735 | GASSRATG | SEQ ID 792 | YGSSPRITF |
| SEQ ID 442 | GFTFSSHLMH | SEQ ID 495 | FIRSKAYGGTTEYAASVKG | SEQ ID 556 | DDKIAAAGFTYWYFDL | SEQ ID 663 | ASQSVRDNVGW | SEQ ID 736 | AASSMTG | SEQ ID 793 | YNNWPPMYTF |

TABLE 6-continued

CDR Amino Acid Sequences

| | VH | | | | | | VL | | | | |
|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| SEQ ID 443 | GGSISS GGYS WS | SEQ ID 496 | RISPGNGV TSYAQKFQ G | SEQ ID 557 | EAADDPFDH | SEQ ID 664 | ASQSISSY LNW | SEQ ID 737 | DVS TRA TD | SEQ ID 794 | FNN WPYT F |
| SEQ ID 444 | GDSVS NNRA AWN | SEQ ID 497 | VISYDGTS KYYGDSV KG | SEQ ID 558 | ADYKYD | SEQ ID 665 | ASQSVNS NVAW | SEQ ID 738 | DAS SRA TG | SEQ ID 795 | SYSIP RTF |
| SEQ ID 445 | GYTFT SYGIS | SEQ ID 498 | YIYHSGST YYNPSLKS | SEQ ID 559 | HRRPIYDILT GFDY | SEQ ID 666 | ASQSVSS SALAW | SEQ ID 739 | DSS SRA TG | SEQ ID 796 | CASS PPVT F |
| SEQ ID 446 | GYSFT SWIG | SEQ ID 499 | YISSSGSYT NYADSVK | SEQ ID 560 | EDTMVRGVI P | SEQ ID 667 | SSQSLLH SNGYNYL DW | SEQ ID 740 | MGS SRA SG | SEQ ID 797 | YGSS PRVT F |
| SEQ ID 447 | GYSFT SYWIA | SEQ ID 500 | WISAYNG NTNYAQK LQG | SEQ ID 561 | DRRYYDSSG YYPAYYFDY | SEQ ID 668 | ASQGISSS LAW | SEQ ID 741 | AAS TLQ | SEQ ID 798 | FNTY PNTF |
| SEQ ID 448 | GFTFT DAWM N | SEQ ID 501 | IIYPGDSDT RYSPSFQG | SEQ ID 562 | DGGYDSSGF HFDY | SEQ ID 669 | SCQSLVY SDGNTYL NC | SEQ ID 742 | KVS NRD SG | SEQ ID 799 | TLHT VTF |
| SEQ ID 449 | GFTFS NNWM T | SEQ ID 502 | WIIPIFGIA NYAQKFQ G | SEQ ID 563 | LPSSGYLQD HHYYGMDV | SEQ ID 670 | ASEGLTT NLAW | SEQ ID 743 | LGS TRA SG | SEQ ID 800 | YGSS LLF |
| SEQ ID 450 | GFTFS SYGM H | SEQ ID 503 | VIYPGDSD TRYSPSFQ G | SEQ ID 564 | AAVGDGYSY GRLD | SEQ ID 671 | SSQSLEH TDGNTYL SW | SEQ ID 744 | AAS TRA TG | SEQ ID 801 | YDNL PPLT F |
| SEQ ID 451 | GFTFD DYAM H | SEQ ID 504 | RVKNKAD GETTDYA APVKG | SEQ ID 565 | LPSYYYDSS GYFTWYFDL | SEQ ID 672 | ASQSISGS YLAW | SEQ ID 745 | KVS TRF SG | SEQ ID 802 | ALQT PYTF |
| SEQ ID 452 | GFTFS NYVM S | SEQ ID 505 | NIKQDGTE KHYVDSV KG | SEQ ID 566 | ELYNYGSKD YFDY | SEQ ID 673 | SSQSLLH SNGNNYL DW | SEQ ID 746 | DAS SRA FG | SEQ ID 803 | GLQT PFTF |
| SEQ ID 453 | GFTFS SYAMS | SEQ ID 506 | VISYDGSN KYYADSV KG | SEQ ID 567 | GGTWDTAM VTGFDY | SEQ ID 674 | ASQNIRH WLVW | SEQ ID 747 | AAS NLQ SG | SEQ ID 804 | YGSS PALT F |
| SEQ ID 454 | GYTFT SYDIN | SEQ ID 507 | AISGSGGS TYYADSV KG | SEQ ID 568 | PHYDILTGSR APFDY | SEQ ID 675 | ASQSIGG SLHW | SEQ ID 748 | YAS QSF SG | SEQ ID 805 | ALHT PWTF |
| SEQ ID 455 | GYTFT DYAIH | SEQ ID 508 | YISSTSSTI YYADSVK G | SEQ ID 569 | ARVESKDGY FDY | SEQ ID 676 | ASQSVTS NYLAW | SEQ ID 749 | GAS YRA TG | SEQ ID 806 | YNH WNY TF |
| SEQ ID 456 | GFTVS SNYMS | SEQ ID 509 | AISGIGDTT YYADSVK G | SEQ ID 570 | DLRLSTWDA YDF | SEQ ID 677 | ASQSISSN LAW | SEQ ID 750 | WAS ARE SG | SEQ ID 807 | GSN WPLT F |
| SEQ ID 457 | GGTFS SYAIS | SEQ ID 510 | WMNPNSG NTGYAQK FQG | SEQ ID 571 | NSQRSFDY | SEQ ID 678 | SSQSVLY SSNNKNY LAW | SEQ ID 751 | TAS KRA TG | SEQ ID 808 | ATHY PRTF |
| SEQ ID 458 | GFTFS SYAIS | SEQ ID 511 | WINAGDG GTKSSREF QG | SEQ ID 572 | DLGDPRGGIL NY | SEQ ID 679 | ASQSLST NLAW | SEQ ID 752 | ASS TLQ SG | SEQ ID 809 | YGSS PIFTF |
| SEQ ID 459 | GFTFS SYAIH | SEQ ID 512 | VIYSGGST YYADSVK G | SEQ ID 573 | SSPWGELSL YQGAFDI | SEQ ID 680 | ASQSISS WLAW | SEQ ID 753 | WAS TRD SG | SEQ ID 810 | GLQI PITF |
| SEQ ID 460 | GYTFT SSDIN | SEQ ID 513 | GIIPIFGTA NYAQKFQ G | SEQ ID 574 | DNDFWSGKV FDY | SEQ ID 681 | ASHSVGA NYIAW | SEQ ID 754 | DAS TRA TG | SEQ ID 811 | HNSY PWTF |

TABLE 6-continued

CDR Amino Acid Sequences

| | VH | | | | VL | | | | | |
|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| SEQ ID 461 | GDSVSSNSAAWN | SEQ ID 514 | GIIPMYGTANYAQKFQG | SEQ ID 575 | EGGSGWRHYFDY | SEQ ID 682 | ASQGIANYLAW | SEQ ID 755 | GASSLQSG | SEQ ID 812 | SISLPLTF |
| SEQ ID 462 | GDSVSSNNAAWN | SEQ ID 515 | WMNPNSGNTGYAEKFQG | SEQ ID 576 | DYCSSTSCQNWFDP | SEQ ID 683 | SSQSVLYRTNNKNYLAW | SEQ ID 756 | KASTLANG | SEQ ID 813 | YASSVTF |
| SEQ ID 463 | GFSLSTSGVG | SEQ ID 516 | RTYYRSKWYNDYAVSVKS | SEQ ID 577 | GRVAGDAFDI | SEQ ID 684 | SNRSVLYSPNNQNYLGW | SEQ ID 757 | GASSRAAG | SEQ ID 814 | YNNWPRTF |
| SEQ ID 464 | GGSISSYYWS | SEQ ID 517 | RTFYRSKWYNDYAVSVKS | SEQ ID 578 | DQGAAAGTLGYFDY | SEQ ID 685 | ASESVNSNFLAW | SEQ ID 758 | KVSNRLSG | SEQ ID 815 | FYSPPRTF |
| SEQ ID 465 | GFTFSSSAMH | SEQ ID 518 | LIYWDDDKRYSPSLKS | SEQ ID 579 | GIYDSSGSSNPFDS | SEQ ID 686 | ASQSIGSNLAW | SEQ ID 759 | GASRRATG | SEQ ID 816 | YGSSPPGTP |
| SEQ ID 466 | GDSVSSDSAVWT | SEQ ID 519 | YIYYTGSTNYNPSLKS | SEQ ID 580 | GYCSGGSCPGTDFDY | SEQ ID 687 | ASQSVGNSLAW | SEQ ID 760 | EVSNRFSG | SEQ ID 817 | YHNWPPYIF |
| SEQ ID 467 | GFTFSTYPMH | SEQ ID 520 | MIWHDESKKYYADSVKG | SEQ ID 581 | DGVGGRDGYNFDY | SEQ ID 688 | ASQSITNWLAW | SEQ ID 761 | AASYRAIG | SEQ ID 818 | YNSYWTF |
| SEQ ID 468 | GFTFAAYNIN | SEQ ID 521 | RTYYKSKWYNDYAASVKS | SEQ ID 582 | APLAADGYFDY | SEQ ID 689 | ARQSISNRLAW | SEQ ID 762 | GASSRASG | SEQ ID 819 | YAAAPITF |
| SEQ ID 469 | GFTFSSYGMT | SEQ ID 522 | VISYDGRNEYYADSVKG | SEQ ID 583 | ARGLQYLIWYFDL | SEQ ID 690 | ASQNVYSNFLAW | SEQ ID 763 | KASTIKSG | SEQ ID 820 | YNSVPLTF |
| SEQ ID 470 | GYTFTGYYMH | SEQ ID 523 | FISYDGSNKYYADSVKG | SEQ ID 584 | PGMVRGVITAPLDY | SEQ ID 691 | SSQSLEHGDGNTYLSW | SEQ ID 764 | AASNLHSG | SEQ ID 821 | YYNLPRSF |
| SEQ ID 471 | GYTLTELSMH | SEQ ID 524 | FIRANADSGTTEYAASVKG | SEQ ID 585 | EAKWGMYYFDY | SEQ ID 692 | ASQSVSSTSLAW | SEQ ID 765 | LGSNRAPG | SEQ ID 822 | YASTPYTF |
| SEQ ID 472 | GFTFSDQYMD | SEQ ID 525 | TISGNGVGTYYPDSVKD | SEQ ID 586 | GGGASYTDS | SEQ ID 693 | ASQSVGSKLAW | SEQ ID 766 | RASSRAIG | SEQ ID 823 | YNNWFLTP |
| SEQ ID 473 | GFTFGDYAMS | SEQ ID 526 | WINPNSGGTNYAQKFQG | SEQ ID 587 | KGGYVGYSYGPFGGY | SEQ ID 694 | SSQSLLGGDGKTYLYW | SEQ ID 767 | EVSNRDSG | SEQ ID 824 | RSNWSLTP |
| SEQ ID 474 | GFNFSGYEMN | SEQ ID 527 | GFDPEDGETIYAQKFQG | SEQ ID 588 | GGTMVRGFGFNY | SEQ ID 695 | ASQSVSSNSLAW | SEQ ID 768 | RASTRAAG | SEQ ID 825 | YGPSRRITF |
| SEQ ID 475 | RFTFSDAWMS | SEQ ID 528 | RVRNKANSYTTEYAASVKG | SEQ ID 589 | ARRAMIGPLPRLVGYFDL | SEQ ID 696 | SSQSLVYSDGNTYLNW | SEQ ID 769 | RASRLESG | SEQ ID 826 | HGEWPTF |
| SEQ ID 476 | GFTFSTYGMH | SEQ ID 529 | AISSNGGSTYYADSVKG | SEQ ID 590 | GRPAPSWVKTRNWFDP | SEQ ID 697 | ASQSISRWLAW | SEQ ID 770 | DSNRATG | SEQ ID 827 | RGTWPPLIF |
| SEQ ID 477 | GISFRDYWMH | SEQ ID 530 | YVSTSGSTRYYADSVKG | SEQ ID 591 | EASSGWN | SEQ ID 698 | PSQDIGTYLNW | SEQ ID 771 | KVSKRDSG | SEQ ID 828 | YTNYPRTF |
| SEQ ID 478 | GDSVSSKSAAWN | SEQ ID 531 | GISGSGGSTYYADSVKG | SEQ ID 592 | GGRYTKGGYFDD | SEQ ID 699 | ASQSISSCLAW | SEQ ID 772 | KASSLTSG | SEQ ID 829 | YQSYWTF |

TABLE 6-continued

CDR Amino Acid Sequences

| | VH | | | | | | VL | | | | | |
|---|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| SEQ ID 479 | GDSVSSGSAAWN | SEQ ID 532 | RIKSKISGGTTDYAAPVQG | SEQ ID 593 | RLDSSGRGGYFDY | SEQ ID 700 | SSQSLLHSDGKTYLYW | SEQ ID 773 | DSSNRATG | SEQ ID 830 | YNSPPRTF |
| SEQ ID 480 | EFTLRNYGVS | SEQ ID 533 | RTYYRSKWYNDYAVSLKS | SEQ ID 594 | ELVGTSSPYYYYYYGMDV | SEQ ID 701 | SSQSVLYSSNNKNYIAW | SEQ ID 774 | GVSTRATG | SEQ ID 831 | YGTSPITF |
| SEQ ID 481 | GGSVSGYYWS | SEQ ID 534 | LISYDGSKKYYANSVKG | SEQ ID 595 | DYYYGSGSSP | SEQ ID 702 | ASQSLTSSYLAW | SEQ ID 775 | GASSRATD | SEQ ID 832 | GIYWPRTF |
| SEQ ID 482 | GDSVSSNTATWN | SEQ ID 535 | WINAGNGNTKYSEKFEG | SEQ ID 596 | GRPYCSSTSCYPEWFDP | SEQ ID 703 | SSQSLVHSNGHTYLSW | SEQ ID 776 | GTSTRATG | SEQ ID 833 | YGSSPPITF |
| SEQ ID 483 | GDSVSGNSAAWN | SEQ ID 536 | RINPDGSSTSYADSVKG | SEQ ID 597 | LRGIDYYDSSGYQRGFDY | SEQ ID 704 | ASQSVGSDLAW | SEQ ID 777 | DASNLETG | SEQ ID 834 | YNNWPPITF |
| SEQ ID 484 | GYTFTSYAIS | SEQ ID 537 | RTYYRSKWNNDYALSVKS | SEQ ID 598 | GGRGDGAAFDI | SEQ ID 705 | SSQSLLHSSGYNYLDW | SEQ ID 778 | AASSLQSG | SEQ ID 835 | TLQTPLTF |
| SEQ ID 485 | GFIFSNYAIH | SEQ ID 538 | RTYYRAKWYNEYAGSVKS | SEQ ID 599 | PPDGGNSGRWYFDL | SEQ ID 706 | ASQTINSWLAW | SEQ ID 779 | EVSKRDSG | SEQ ID 836 | YYSSTPYTF |
| | | SEQ ID 539 | GMSGSGYSTYYADSVKG | SEQ ID 600 | DKNVRKHDYGDHPYGGYFDY | SEQ ID 707 | ASQTIGPKSFGW | SEQ ID 780 | WASTRGSG | SEQ ID 837 | STQFPWTF |
| | | SEQ ID 540 | EIHHSGSTNYNPSLKS | SEQ ID 601 | VAGATSLWY | SEQ ID 708 | SSQSLVYSDGNTYLYW | SEQ ID 781 | KISNRFSG | SEQ ID 838 | YNNWPHTF |
| | | SEQ ID 541 | RTYYRSKWYKDNALSVKS | SEQ ID 602 | LANSDGVDV | SEQ ID 709 | ASQSITTWLAW | SEQ ID 782 | KASSLESG | SEQ ID 839 | YGNSQTF |
| | | SEQ ID 542 | LIYSDGRTNYADSVKG | SEQ ID 603 | GVTRTFDY | SEQ ID 710 | ASQSIGTYVAW | SEQ ID 783 | GASTRATA | SEQ ID 840 | GTHWPRTF |
| | | SEQ ID 543 | AISSNGGSTYYANSVKG | SEQ ID 604 | GNGPFDP | SEQ ID 711 | ASQSVNSGYLAW | | | SEQ ID 841 | YKSDSRTF |
| | | SEQ ID 544 | WISAYDGNTNYAQKLQG | SEQ ID 605 | RDTPLVGVSIY | SEQ ID 712 | ASQSVSSYLGW | | | SEQ ID 842 | SYGPRTF |
| | | SEQ ID 545 | YISSSGTTIYYADSVKG | SEQ ID 606 | RAGYGDYRHFQH | SEQ ID 713 | ASQSISNNLAW | | | SEQ ID 843 | YGSSGYTF |
| | | SEQ ID 546 | VIWYDGSNKYYADSVKG | SEQ ID 607 | TGDRFQEFDY | SEQ ID 714 | ASQSVSSSLAW | | | SEQ ID 844 | YGSSP |
| | | | | SEQ ID 608 | DDRGRGDDFDY | SEQ ID 715 | SNQSLVYSDGGTYLNW | | | SEQ ID 845 | LNSYPQTF |
| | | | | SEQ ID 609 | HGRAGINWYFDL | SEQ ID 716 | ASQSISNYLNW | | | SEQ ID 846 | SIQLPLTF |
| | | | | SEQ ID 610 | GGGLWAFDI | SEQ ID 717 | ASQSVSTLLAW | | | SEQ ID 847 | YYYIPRTF |

TABLE 6-continued

CDR Amino Acid Sequences

| VH | | | | | | VL | | | | | |
|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| | | | | SEQ ID 611 | DKIGSCPY | SEQ ID 718 | ASQGIRN DLGW | | | SEQ ID 848 | ALQT RTF |
| | | | | SEQ ID 612 | RPDSSSQCFD Y | SEQ ID 719 | SSHSLTT TDGRTYV AW | | | SEQ ID 849 | YGSS PNTF |
| | | | | SEQ ID 613 | SSGWSLPED Y | SEQ ID 720 | ASQSVTS NLAW | | | SEQ ID 850 | GTH WPPL TV |
| | | | | SEQ ID 614 | DVNPELLGA GFDY | SEQ ID 721 | ASQSVFN NYLAW | | | SEQ ID 851 | YGRS PYTS |
| | | | | SEQ ID 615 | SLNSGGYRC FHH | SEQ ID 722 | SSQSVLY DSNSKNY LSW | | | SEQ ID 852 | YYST PLTF |
| | | | | SEQ ID 616 | APRGVVPAA MRGGY | SEQ ID 723 | ASQSVGT NLAW | | | SEQ ID 853 | GLQI PLTF |
| | | | | SEQ ID 617 | LVGNSGSYY PFGY | SEQ ID 724 | SSQSLVY SDGNTYL SW | | | SEQ ID 854 | SIQLP WTF |
| | | | | SEQ ID 618 | GRSLPYRGL APRSFGGYY FDY | SEQ ID 725 | ASQSVIS RYLAW | | | SEQ ID 855 | YNN WPRF |
| | | | | SEQ ID 619 | GRTHWGPQD FDY | SEQ ID 726 | ASQSVSS SLAW | | | SEQ ID 856 | YNSY SPTF |
| | | | | SEQ ID 620 | GGMYYYGS GSSYFDY | | | | | SEQ ID 857 | RYN WPIT F |
| | | | | SEQ ID 621 | KIAAAGKQP VDY | | | | | SEQ ID 858 | RSRW PLTF |
| | | | | SEQ ID 622 | RKVYDYVW GSYRLPGSVS YYFDY | | | | | SEQ ID 859 | GRH WPYT L |
| | | | | SEQ ID 623 | LPGRAARPD Y | | | | | SEQ ID 860 | YNSY SRTF |
| | | | | SEQ ID 624 | GPGAVAGTK PKYYFDY | | | | | SEQ ID 861 | YNG ASRM F |
| | | | | SEQ ID 625 | ATYYYDSSG YRFDY | | | | | SEQ ID 862 | RSN WPFF |
| | | | | SEQ ID 626 | RNLGY | | | | | SEQ ID 863 | RAE WPLT F |
| | | | | SEQ ID 627 | ARYYDSSGY IAPSGYFDY | | | | | SEQ ID 864 | YGNS AMY NF |
| | | | | SEQ ID 628 | DGPAVDGAE YFQH | | | | | SEQ ID 865 | YNN WPPF TF |

TABLE 6-continued

CDR Amino Acid Sequences

| VH | | | | | | VL | | | | | |
|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| | | | | SEQ ID 629 | LASGSPPPGDY | | | | | SEQ ID 866 | YGISPLAF |
| | | | | SEQ ID 630 | GPIVGATMDY | | | | | SEQ ID 867 | YNFWPSITF |
| | | | | SEQ ID 631 | WYGDYGLDY | | | | | SEQ ID 868 | YGSSQTF |
| | | | | SEQ ID 632 | VAKYYYESGGYRASNWFDP | | | | | SEQ ID 869 | GTHWPYTF |
| | | | | SEQ ID 633 | APPPTVGWYAPVFDY | | | | | SEQ ID 870 | FDNVPVTF |
| | | | | SEQ ID 634 | VTGRRVGAHDY | | | | | SEQ ID 871 | YGSSSMYTF |
| | | | | SEQ ID 635 | AQPGAETLNFDL | | | | | SEQ ID 872 | SYITPWTP |
| | | | | SEQ ID 636 | QVAGGMDV | | | | | SEQ ID 873 | RYVWPFTF |
| | | | | SEQ ID 637 | GSVYSGSYYMLIDY | | | | | SEQ ID 874 | HNSYPRTF |
| | | | | SEQ ID 638 | QDKDNTRYSGLGV | | | | | SEQ ID 875 | RSNWPWTF |
| | | | | SEQ ID 639 | GPRMWSSGIDAFDI | | | | | SEQ ID 876 | GTHGPHTF |
| | | | | SEQ ID 640 | RDWAGKRV | | | | | SEQ ID 877 | YGSPPPTTF |
| | | | | SEQ ID 641 | GRAGIAAFDI | | | | | SEQ ID 878 | YGSSRRTF |
| | | | | SEQ ID 642 | GALQGEWRRFDY | | | | | SEQ ID 879 | YGSSPITF |
| | | | | SEQ ID 643 | TNQGYGGNSGVFDY | | | | | SEQ ID 880 | YGSSLRYTF |
| | | | | SEQ ID 644 | IVGGAVDC | | | | | SEQ ID 881 | FYGIPHF |
| | | | | SEQ ID 645 | VRVGATTVYDSWFDP | | | | | SEQ ID 882 | GTQFPQTF |
| | | | | SEQ ID 646 | DGGSSPYYDSSGLLPWYFDL | | | | | SEQ ID 883 | YGSSPPYTF |

TABLE 6-continued

CDR Amino Acid Sequences

| VH | | | | | | VL | | | | | |
|---|---|---|---|---|---|---|---|---|---|---|---|
| SEQ ID | CDRH1 | SEQ ID | CDRH2 | SEQ ID | CDRH3 | SEQ ID | CDRL1 | SEQ ID | CDRL2 | SEQ ID | CDRL3 |
| | | | | SEQ ID 647 | AKFWTYYFDY | | | | | SEQ ID 884 | YNSYSGTF |
| | | | | SEQ ID 648 | GGGSGSYYKRFFDY | | | | | SEQ ID 885 | YDNWPPLF |
| | | | | SEQ ID 649 | DGTVRRVVGATTPGNFDY | | | | | | |
| | | | | SEQ ID 650 | DLNRGYCSGGSCFGY | | | | | | |
| | | | | SEQ ID 651 | DYSSSGECFDY | | | | | | |
| | | | | SEQ ID 652 | DQAAMVGYFDY | | | | | | |
| | | | | SEQ ID 653 | TFAGYSSKLGYFDL | | | | | | |

TABLE 7

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| SEQ ID 1004 | GGGGACAGTGTCTCTAGCAACACTGCTACTTGGAAC | SEQ ID 1062 | AGGACATACTACAGGTCCAAGTGGTATAAGGATAATGCACTGTCTGTGAAAAGT | SEQ ID 1127 | GCCCGGCGGGCTATGATAGGGCCGCTTCCGCGACTTGTCGGGTACTTGATCTC |
| SEQ ID 1005 | GGATTCACCTTCAGTTCCCATCTTATGCAC | SEQ ID 1063 | GTTATATCATATGATGGAACTAGTAAATATTACGGAGACTCCGTGAAGGGC | SEQ ID 1128 | GGCCGCCCCGCCCCATCCTGGGTTAAAACCCGTAACTGGTTCGACCCC |
| SEQ ID 1006 | GGGGACAGTGTCTCTAGCGGCAGTGCTGCTTGGAAC | SEQ ID 1064 | AGGACATATTATAGGGCCAAGTGGTATAATGAATATGCAGGGTCTGTGAAAAGC | SEQ ID 1129 | GGAGGAATGTATTACTATGGTTCGGGGAGCTCGTACTTTGACTAC |
| SEQ ID 1007 | GGTTACACCTTTACCAGCTACGGTATCAGCTCCAGGGC | SEQ ID 1065 | TGGATCAGCGCTTACAATGGTAACACAAACTATGCACAGAAGCATCGTACTACTTTGACTAC | SEQ ID 1130 | AGGAAGGTGTATGATTACGTTTGGGGAGTTATCGCCTCCCCGGGTCGGT |
| SEQ ID 1008 | GGATTCACCTTCAGTAGCTATGCTATACAC | SEQ ID 1066 | CTCATTTATTGGGATGATGATAAGCGCTACAGCCCATCTCTGAAGAGC | SEQ ID 1131 | AAGGGGGGCTACGTCGGATACAGCTATGGACCTTTTGGGGGCTAC |
| SEQ ID 1009 | GGGTTCTCACTCAGCACTAGTGGAGTGGGTGTGGGC | SEQ ID 1067 | TGGATGAACCCTAACAGTGGTAACACCGGCTATGCAGAGAAGTTCCAGGGC | SEQ ID 1132 | GGTCGGGCTGGTATTGCCGCTTTTGATATC |
| SEQ ID 1010 | GGATACACCTTCACCAGTTCTGATATCAAC | SEQ ID 1068 | GTTATATCATATGATGGAAGTAATAAATACTACGCAGACTCCGTGAAGGGC | SEQ ID 1133 | GCAGATTATAAATATGACT |
| SEQ ID 1011 | GGATTCACCTTCAGTAGCTATGCTATGCAC | SEQ ID 1069 | ACTATTAGTGGTAATGGTGTTGGCACATACTACCCAGACTCCGTGAAGGAC | SEQ ID 1134 | AGCAGTGGCTGGTCACTGCCTGAAGACTAC |
| SEQ ID 1012 | GGATTCACCTTTAGCAGCTATGGCATGACG | SEQ ID 1070 | GTTATATGGTATGATGGAAGTAATAAATACTATGCAGACTCCGTGAAGGGC | SEQ ID 1135 | CAAGACAAAGACAACACGAGATATTCCGGTTTGGGCGTC |

TABLE 7-continued

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| SEQ ID 1013 | GGATACACCTTCGCCGC CTATTATTTACAC | SEQ ID 1071 | CGGATCAGCCCTGGTAACGGT GTCACAAGTTATGCACAGAAA TTTCAGGGC | SEQ ID 1136 | GCCGCGGTGGGGGATGGATACAGCT ATGGTCGGCTCGATT |
| SEQ ID 1014 | GGATACACCTTCACCGG CTACTATATGCAC | SEQ ID 1072 | TGGATCAACCCTAACAGTGGT GGCACAAACTATGCACAGAAG TTTCAGGGC | SEQ ID 1137 | GATCAGGCAGCTATGGTAGGCTACT TTGACTAC |
| SEQ ID 1015 | GGATACACCTTCACCAG TTATGATATCAAC | SEQ ID 1073 | TGGATGAACCCTAACAGTGGT AACACAGGCTATGCACAGAAG TTCCAGGGC | SEQ ID 1138 | GGCCGGCCATATTGTAGTAGTACCA GCTGCTACCCAGAGTGGTTCGACCC C |
| SEQ ID 1016 | GGATTCATCTTCAGTAAC TATGCTATACAC | SEQ ID 1074 | CGTGTTAAAAACAAAGCTGAT GGTGAGACAACGGACTACGCT GCACCCGTCAAAGGC | SEQ ID 1139 | AGATTGGATAGCAGTGGCCGTGGTG GTTACTTTGACTAC |
| SEQ ID 1017 | GGATTCACTTTCACTGAT GCCTGGATGAAC | SEQ ID 1075 | GCTATTAGTGGTAGTGGTGGTA GCACATACTATGCAGACTCCGT GAAGGGC | SEQ ID 1140 | GACAAGAACGTCCGAAAACATGAC TACGGTGACCACCCCTACGGGGGT ACTTTGACTAC |
| SEQ ID 1018 | GGTGGGTCCGTCAGTGG TTACTACTGGAGC | SEQ ID 1076 | GAAATCCATCATAGTGGAAGC ACCAACTACAACCCGTCCCTCA AGAGT | SEQ ID 1141 | GAGTTGGTGGGTACCAGCTCTCCTT ATTACTACTACTACGGTATGGA CGTC |
| SEQ ID 1019 | GGATTCAACTTCAGTGG ATATGAAATGAAC | SEQ ID 1077 | TACGTCAGTACTAGTGGTAGTA CCAGATACTACGCAGACTCTGT GAAGGGC | SEQ ID 1142 | GGTGGGGGTGCGAGCTATACTGACT CC |
| SEQ ID 1020 | GGGGACAGTGTCTCTAG CAACAGTGTTACTTGGA AC | SEQ ID 1078 | AGGACTTACTACCGGTCCCAGT GGTATTATAATTATGCGGTGTC TGTGAAAAGT | SEQ ID 1143 | TCGAGCCCCTGGGGGAGTTATCGT TATACCAGGGGGCTTTTGATATC |
| SEQ ID 1021 | GGATTCACCTTCAGCAG CTATGCTATGCAC | SEQ ID 1079 | CGTATTAATCCTGATGGGAGTA GCACAAGCTACGCGGACTCCG TGAAGGGC | SEQ ID 1144 | GTGGCGGGAGCTACTTCCCTATGGT AC |
| SEQ ID 1022 | GGAATCAGCTTCAGAGA TTACTGGATGCAC | SEQ ID 1080 | TGGATCAACGCTGGCAATGGT AACACAAAATATTCACAGAAG TTCCAGGGC | SEQ ID 1145 | CATGGTAGGGCCGGAATAAACTGGT ACTTCGATCTC |
| SEQ ID 1023 | GGATACACCTTCACTAG CTATGCTATGCAT | SEQ ID 1081 | CTTATTTATAGTGATGGTCGCA CAAACTATGCAGACTCCGTGA AGGGC | SEQ ID 1146 | GCGCCCCTCCGACTGTTGGCTGGT ACGCCCCGTCTTTGACTAC |
| SEQ ID 1024 | GGGTTCACCGTCAGTAG CAACTACATGAGC | SEQ ID 1082 | AACATAAAGCAAGATGGAACT GAGAAACACTATGTGGACTCT GTGAAGGGC | SEQ ID 1147 | GACTATTACTATGGTTCGGGGAGTT CTCCC |
| SEQ ID 1025 | GGATTCACCTTTAGTAAC AATTGGATGACC | SEQ ID 1083 | GGTATGAGTGGTAGTGGTTATA GTACATACTACGCAGACTCCGT GAAGGGC | SEQ ID 1148 | GATCTGAATCGAGGATATTGTAGTG GTGGTAGCTGCTTTGGCTAC |
| SEQ ID 1026 | GAATTCACCCTTAGGAA CTATGGCGTGAGC | SEQ ID 1084 | GCTATTAGTAGTAATGGGGGT AGCACATACTACGCAGACTCA GTGAAGGGC | SEQ ID 1149 | GCCCAGCCGGGCGCTGAGACGTTGA ACTTCGATCTC |
| SEQ ID 1027 | GGTTACACATTTACCAGT TATGCCATCAGC | SEQ ID 1085 | TGGATCAGCGCTTACGACGGT AACACAAACTATGCACAGAAG CTCCAGGGC | SEQ ID 1150 | CCGGGTATGGTTCGGGGAGTTATTA CTGCCCCGCTTGACTAC |
| SEQ ID 1028 | GGATTCACCTTCAGTACC TATCCCATGCAC | SEQ ID 1086 | GTTATATCATATGATGGACGTA ATGAATACTACGCAGACTCCGT GAAGGGC | SEQ ID 1151 | GGGGGGACTATGGTTCGGGGTTTCG GATTTAACTAC |
| SEQ ID 1029 | GGATTCACCTTTGATGAT TATGCCATGCAC | SEQ ID 1087 | GCTATTAGTGGTAGTGGTGTA GCACATACTACGCAGACTCCGT GAAGGGC | SEQ ID 1152 | GCCACGTATTACTATGATAGTAGTG GTTATAGGTTTGACTAC |
| SEQ ID 1030 | GGGGACAGTGTCTCTAA CAACAGGGCTGCTTGGA AC | SEQ ID 1088 | AGGACATACTACAGGTCCAAG TGGTATAATGAATATGCAGTCT CTGTGAAAAGT | SEQ ID 1153 | GAGGCTGCCGACGACCCGTTTGACC AT |
| SEQ ID 1031 | GGATTCACCTTCAGTGA CCCCTACATGGAC | SEQ ID 1089 | CGAATTACAAATAAGCGTACC GGTTACGCCACAACATATGCC GCGTCTGTGAAGGAC | SEQ ID 1154 | GGCCCCGGGCAGTGGCTGGTACTA AGCCAAAGTACTACTTTGACTAC |

TABLE 7-continued

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| SEQ ID 1032 | GGATTCACTTTCAGTAACGCCTGGATGAGC | SEQ ID 1090 | CGTATTAAAAGCAAAACTGATGGTGGGACAACAGACTACGCTGCACCCGTGAAAGGC | SEQ ID 1155 | GACAAGATCGGCAGCTGTCCTTAC |
| SEQ ID 1033 | GGGGACAGTGTCTCTAGCAACAGTGCTGCTTGGAAC | SEQ ID 1091 | AGGACATACTACAGGTCCAAGTGGTATAATGATTATGCAGTATCTGTGAAAAGT | SEQ ID 1156 | GGAATCTATGATAGTAGTGGTTCTTCCAATCCCTTTGACTCC |
| SEQ ID 1034 | GGATTCACCTTCAGTAGCTATGCTATGCAT | SEQ ID 1092 | TACATCTATCATAGTGGGAGCACCTACTACAACCCGTCCCTCAAGAGT | SEQ ID 1157 | ACTTTTGCGGGGTATAGCAGCAAACTGGGGTACTTCGATCTC |
| SEQ ID 1035 | GGTGGCTCCATCAGCAGTGGTGGTTACTCCTGGAGC | SEQ ID 1093 | AGGACTTACTACAGGTCCAAGTGGTATAATGATTATGCAGTATCTCTGAAAAGT | SEQ ID 1158 | GCCCGAGTGGAATCCAAGGATGGGTACTTTGACTAC |
| SEQ ID 1036 | GGGGACAGTGTCTCTGGCAACAGTGCTGCTTGGAAC | SEQ ID 1094 | TTCATTAGAGCCAACGCTGATAGTGGGACAACAGAGTACGCCGCGTCTGTGAAAGGC | SEQ ID 1159 | GACCTGCGACTTTCTACGTGGGATGCTTATGATTTC |
| SEQ ID 1037 | GGATTCACCTTTGCTGCTTATAATATCAAC | SEQ ID 1095 | AGGACATACTACAGGTCCAAGTGGTATAATGATTATGCAGTATCTGTGAAGAGT | SEQ ID 1160 | GGATCGGTATATAGTGGGAGCTACTATATGCTCATTGACTAC |
| SEQ ID 1038 | GGGGACAGTGTCTCTAGCAACAATGCTGCTTGGAAC | SEQ ID 1096 | AGGACATTCTACAGGTCCAAGTGGTATAATGACTATGCAGTTTCTGTGAAAAGT | SEQ ID 1161 | CGGGATTGGGCAGGAAAAAGGGTC |
| SEQ ID 1039 | GGTTACACCTTTACCAGCTATGGTATCAGC | SEQ ID 1097 | TGGATCATCCCTATCTTTGGTATAGCAAACTACGCACAGAAGTTCCAGGGC | SEQ ID 1162 | GATGGGGGGTCCAGCCCATACTATGATAGTAGTGGTTTACTACCCTGGTACTTCGATCTC |
| SEQ ID 1040 | GGATTCACCTTTAGCAGCTATGCCATGAGC | SEQ ID 1098 | TGGATCAACGCTGGCAATGGTAACACAAAATATTCAGAGAAGTTCGAAGGC | SEQ ID 1163 | GGCAATGGGCCGTTCGACCCC |
| SEQ ID 1041 | GGATTCACCTTTAGCAACTATGTCATGAGC | SEQ ID 1099 | TACATCAGTAGTACTAGTAGTACCATATACTACGCAGACTCCGTGAAGGGC | SEQ ID 1164 | GGACGGACTCACTGGGGCCCCCAGGACTTTGACTAC |
| SEQ ID 1042 | GGATTCACCTTCAGCAGCTCTGCCATGCAC | SEQ ID 1100 | GCTATTAGTGGTATTGGTGATACTACATATACGCGGACTCCGTGAAGGGC | SEQ ID 1165 | AGGGGACATAACTACGGTGTAGATTAC |
| SEQ ID 1043 | GGAGGCACCTTCAGCAGCTATGCTATCAGC | SEQ ID 1101 | AGGACATATTACAGGTCCAAGTGGTATAATGATTATGCAGTATCTGTGAAAAGT | SEQ ID 1166 | GATTATTGTAGTAGTACCAGCTGCCAGAACTGGTTCGACCCC |
| SEQ ID 1044 | GGATACAGCTTTACCAGCTACTGGATCGCC | SEQ ID 1102 | ATGATTTGGCATGATGAGAGTAAGAAATACTATGCAGACTCCGTGAAGGGC | SEQ ID 1167 | TGGTACGGTGACTACGGCCTTGACTAC |
| SEQ ID 1045 | CGATTCACTTTCAGTGACGCCTGGATGAGC | SEQ ID 1103 | GGGATCATCCCTATCTTTGGTACAGCAAACTACGCACAGAAGTTCCAGGGC | SEQ ID 1168 | GTTACGGGACGGAGAGTGGGAGCCCATGACTAC |
| SEQ ID 1046 | GGATTCACCTTCAGTACCTATGGCATGCAC | SEQ ID 1104 | GTCATCTATCCTGGTGACTCTGATACCAGATACAGCCCGTCCTTCCAAGGC | SEQ ID 1169 | GGCTCCTTGTCCCGAAGTGGCTGGTACGCCGGACTCTTTGACTAC |
| SEQ ID 1047 | GGATTCACCGTCAGTAGCAACTACATGAGC | SEQ ID 1105 | CGTATTAAAAGCAAAATAAGTGGTGGGACAACAGACTACGCTGCACCCGTGCAAGGC | SEQ ID 1170 | GGGGCCCTACAGGGCGAATGGCGGAGATTTGACTAC |
| SEQ ID 1048 | GGATTCACCTTCAGTAGCTATAGCATGAAC | SEQ ID 1106 | GCTATTAGTAGTAATGGGGTAGCACATATTATGCAAACTCTGTGAAGGGC | SEQ ID 1171 | AACAGTCAACGTTCGTTTGACTAC |
| SEQ ID 1049 | GGGGACAGTGTCTCTAGCGACAGTGCTGTTTGGACC | SEQ ID 1107 | GGTATTAGTGGTAGTGGTGTAGCACATACTACGCAGACTCCGTGAAGGGC | SEQ ID 1172 | GGGCCCCGAATGTGGAGCAGTGGCATTGATGCTTTTGATATC |
| SEQ ID 1050 | GGATTCACCTTTGGTGATTATGCTATGAGC | SEQ ID 1108 | CTTATATCATATGATGGAAGTAAAAAATACTATGCAAACTCCGTGAAGGGC | SEQ ID 1173 | CGGGCGGGTTACGGTGACTACAGACACTTCCAGCAC |

TABLE 7-continued

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| SEQ ID 1051 | GGATTCACCTTCAGTAGTTATAGCATGAAC | SEQ ID 1109 | GTTATTTATAGCGGTGGTAGCACATACTACGCAGACTCCGTGAAGGGC | SEQ ID 1174 | CATAGACGCCCAATTTACGATATTTTGACTGGTTTTGACTAC |
| SEQ ID 1052 | GGATACACCTTCACTGATTATGCTATACAT | SEQ ID 1110 | TACATTAGTAGTAGTGGTAGTTACACAAACTACGCAGACTCTGTGAAGGGC | SEQ ID 1175 | GATGGTACGGTCCGAAGGGTAGTGGGAGCTACTACCCTGGAAACTTTGACTAC |
| SEQ ID 1053 | GGTGGCTCCATCAGTAGTTACTACTGGAGC | SEQ ID 1111 | CGTATTAAAAGCAAAACTGATGGTGAGACAACAGACTACGCTGCACCCGTGAAAGGC | SEQ ID 1176 | CGGGATACACCTTTGGTTGGGGTTTCGATATAC |
| SEQ ID 1054 | GGATTCACCTTCAGTAGCTATGGCATGCAC | SEQ ID 1112 | AGGACATACTACAAGTCGAAGTGGTATAATGATTATGCAGCATCTGTGAAAAGT | SEQ ID 1177 | GATAACGATTTTTGGAGTGGGAAAGTCTTTGACTAC |
| SEQ ID 1055 | GGATTCACCTTCAGTGACCAGTACATGGAC | SEQ ID 1113 | TTCATTAGAAGCAAAGCTTATGGTGGACAACAGAATACGCCGCGTCTGTGAAAGGC | SEQ ID 1178 | GGCCGGTCCCTTCCCTACCGGGGGTTGGCTCCTAGATCTTTCGGAGGATACTACTTTGACTAC |
| SEQ ID 1056 | GGTGGGTCCTTCAGTGGTTACTACTGGAGC | SEQ ID 1114 | TACATTAGTAGTAGTGGTACTACCCATATACTACGCAGACTCTGTGAAGGGC | SEQ ID 1179 | TTGCCTAGTAGTGGTTATCTACAGGACCACCACTACTACGGTATGGACGTC |
| SEQ ID 1057 | GGATTCACCTTCAGCAGCTATGCTATCAGC | SEQ ID 1115 | ATTATATCAGATGATGAAGTAAGAGTTACTACGCAGACTCCGTGCAGGGC | SEQ ID 1180 | GATGTCAGTGGGTCCTTCGCGGCCTAC |
| SEQ ID 1058 | GGATACACCTTCACCAGCTACTATATGCAC | SEQ ID 1116 | TGGATCAACGCTGGCGATGGTGGCACAAAAAGTTCACGGGAGTTCCAGGGC | SEQ ID 1181 | GACGAGTATTTCTAC |
| SEQ ID 1059 | GGGGACAGTGTCTCTAGCAAAAGTGCTGCTTGGAAC | SEQ ID 1117 | TATATCTATTACACTGGGAGCACCAACTACAACCCCTCCCTCAAGAGC | SEQ ID 1182 | GAGGCTAGCAGTGGCTGGAAC |
| SEQ ID 1060 | GGATACAGCTTTACCAGCTACTGGATCGGC | SEQ ID 1118 | GTTATATCATATGATGGAAGTAATAAATACTATGCAGACTCCGTGAAGGGC | SEQ ID 1183 | GAGGGCGGAGCAGTGGCTGGTACTGTCTAC |
| SEQ ID 1061 | GGATACACCCTCACTGAATTATCCATGCAC | SEQ ID 1119 | CGTGTTAGAAACAAAGCTAACAGTTACACCACAGAATACGCCGCGTCTGTGAAAGGC | SEQ ID 1184 | GATCGGCGTTACTATGATAGTAGTGGTTATTATCCCGCCTACTACTTTGACTAC |
| | | SEQ ID 1120 | GAAATCAATCATAGTGGAAGCACCAACTACAACCCGTCCCTCAAGAGT | SEQ ID 1185 | GGCGGTACTTGGGATACAGCTATGGTTACGGGCTTTGACTAC |
| | | SEQ ID 1121 | GGGATCATCCCTATGTATGGTACAGCAAACTACGCACAGAAGTTCCAGGGC | SEQ ID 1186 | ATAGTGGGAGGTGCCGTTGACTGC |
| | | SEQ ID 1122 | ATAATCAACCCTAGTGGTGGTAGCACAAGCTACGCACAGAAGTTCCAGGGC | SEQ ID 1187 | GAGGATACTATGGTTCGGGGAGTTATTCCC |
| | | SEQ ID 1123 | AGGACATACTACAGGTCCAAATGGAATAATGATTATGCATTATCTGTGAAAAGT | SEQ ID 1188 | TTGGCGAGTGGTTCCCCCCCTCCGGGGGACTAC |
| | | SEQ ID 1124 | ATCATCTATCCTGGTGACTCTGATACCAGATACAGCCCGTCCTTCCAAGGC | SEQ ID 1189 | GTTAGAGTGGGAGCTACTACTGTTTACGACAGCTGGTTCGACCCC |
| | | SEQ ID 1125 | TTTATATCATATGATGGAAGTAATAAATACTACGCAGACTCCGTGAAGGGC | SEQ ID 1190 | GATGATCGGGTCGGGGAGATGACTTTGACTAC |
| | | SEQ ID 1126 | GGTTTTGATCCTGAAGATGGTGAAACAATCTACGCACAGAAGTTCCAGGGC | SEQ ID 1191 | CTAGCTAATTCCGACGGTGTGGACGTC |
| | | | | SEQ ID 1192 | GGCGGTGGTTCGGGGAGTTATTATAGAGGTTCTTTGACTAC |

TABLE 7-continued

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| | | | | SEQ ID 1193 | GGGGGAAGATATACCAAGGGAGGG TACTTTGACGAC |
| | | | | SEQ ID 1194 | GAACTATACAACTATGGTTCAAAGG ACTACTTTGACTAC |
| | | | | SEQ ID 1195 | GATGGCCCCGCCGTTGATGGTGCTG AATACTTCCAGCAC |
| | | | | SEQ ID 1196 | GTCGCCAAATATTATTACGAGAGTG GTGGTTATCGGGCCTCCAACTGGTT CGACCCC |
| | | | | SEQ ID 1197 | GAAGGGGCAGTGGCTGGCGCCAC TACTTTGACTAC |
| | | | | SEQ ID 1198 | GATCAAGGGGCAGCAGCTGGTACCC TGGGGTACTTTGACTAC |
| | | | | SEQ ID 1199 | GGGCGCGTGGCGGGGGATGCTTTTG ATATC |
| | | | | SEQ ID 1200 | ACCAACCAGGGATACGGTGGTAACT CCGGGGTATTTGACTAC |
| | | | | SEQ ID 1201 | CCCCCCGACGGTGGTAACTCCGGTC GCTGGTACTTCGATCTC |
| | | | | SEQ ID 1202 | GCCCGGGGGCTACAGTACCTAATCT GGTACTTCGATCTC |
| | | | | SEQ ID 1203 | GCTCGTTACTATGATAGTAGTGGTT ATATTGCCCCATCGGGTTACTTTGA CTAC |
| | | | | SEQ ID 1204 | GATGGTGTAGGAGGGAGAGATGGC TACAATTTTGACTAC |
| | | | | SEQ ID 1205 | CCCCATTACGATATTTTGACTGGTTC CCGGGCGCCCTTTGACTAC |
| | | | | SEQ ID 1206 | CGAAACTTAGGCTAC |
| | | | | SEQ ID 1207 | GCTAAGTTTTGGACATACTACTTTG ACTAC |
| | | | | SEQ ID 1208 | AAAATAGCAGCAGCTGGTAAGCAA CCTGTTGACTAC |
| | | | | SEQ ID 1209 | GGCCCTATAGTGGGAGCGACTATGG ACTAC |
| | | | | SEQ ID 1210 | AGACCGGATAGCAGCAGTCAATGTT TTGACTAC |
| | | | | SEQ ID 1211 | GCCCCCCTAGCAGCAGATGGCTACT TTGACTAC |
| | | | | SEQ ID 1212 | GACGGGGCTATGATAGTAGTGGTT TTCACTTTGACTAC |
| | | | | SEQ ID 1213 | GGGGTGGGATGGTCGCCCTTCCAAT AC |
| | | | | SEQ ID 1214 | GGTGTAACCCGGACCTTTGACTAC |
| | | | | SEQ ID 1215 | GACGACAAAATAGCAGCAGCTGGA TTCACATACTGGTACTTCGATCTC |
| | | | | SEQ ID 1216 | GATTATAGCAGCTCGGGGGAGTGCT TTGACTAC |

TABLE 7-continued

Heavy Chain CDR DNA Sequences

| SEQ ID | CDRH1 DNA Seq | SEQ ID | CDRH2 DNA Seq | SEQ ID | CDRH3 DNA Seq |
|---|---|---|---|---|---|
| | | | | SEQ ID 1217 | TTAAGGGGTATAGATTACTATGATAGTAGTGGTTACCAACGGGGGTTTGACTAC |
| | | | | SEQ ID 1218 | GCGCCGAGGGGTGTAGTACCAGCTGCTATGCGGGGGGCTAC |
| | | | | SEQ ID 1219 | GACAGGGGAACTAAATGGAACCAATTGAATGATGTTTTTGATATG |
| | | | | SEQ ID 1220 | GGATATTGTAGTGGTGGTAGCTGCCCAGGAACGGATTTTGACTAC |
| | | | | SEQ ID 1221 | GGTGGGAGGGGGATGGGGCCGCTTTTGACATC |
| | | | | SEQ ID 1222 | GATTTAGGGGATCCCCGGGGTGGTATTTTGAACTAC |
| | | | | SEQ ID 1223 | AGTCTCAATAGTGGGGCTACCGATGCTTCCATCAC |
| | | | | SEQ ID 1224 | GTAAATCCGGGGAGTTATACGAGGGAGGTGAGCAACTTTGACTAC |
| | | | | SEQ ID 1225 | CTCCCGGGGAGAGCAGCTCGTCCAGACTAC |
| | | | | SEQ ID 1226 | GAAGCTAAGTGGGGAATGTACTACTTTGACTAC |
| | | | | SEQ ID 1227 | GGCCGAGGGTATAGCAGCAGTCGGCTCTACTACTTTGACTAC |
| | | | | SEQ ID 1228 | TTGGTGGGCAATAGTGGGAGCTACTATCCGTTTGGGTAC |
| | | | | SEQ ID 1229 | CAAGTCGCGGGCGGTATGGACGTC |
| | | | | SEQ ID 1230 | GGGGGAGGGCTTTGGGCTTTTGATATC |
| | | | | SEQ ID 1231 | CTCCCCTCGTATTACTATGATAGTAGTGGTTACTTTACCTGGTACTTCGATCTC |
| | | | | SEQ ID 1232 | ACAGGGGACCGCTTCCAAGAGTTTGACTAC |
| | | | | SEQ ID 1233 | GATGTGAACCCGGAGCTACTGGGGGCGGGATTTGACTAC |

TABLE 8

Light Chain CDR DNA Sequences

| SEQ ID | CDRL1 DNA Seq | SEQ ID | CDRL2 DNA Seq | SEQ ID | CDRL3DNASeq |
|---|---|---|---|---|---|
| SEQ ID 1234 | GCCAGTCAGAGTGTCGGTAACTCCTTAGCCTGG | SEQ ID 1308 | GGTGCGTCCAGTTTGCAGAGTGGG | SEQ ID 1373 | CAACGTGGCACCTGGCCTCCCCTCACTTTC |
| SEQ ID 1235 | GCCAGTCAGAGTATAACTAACTGGTTGGCCTGG | SEQ ID 1309 | AGGGCGTCTCGTTTAGAAAGTGGG | SEQ ID 1374 | CAGTATACTAATTACCCTCGTACGTTC |
| SEQ ID 1236 | GCCAGTCAGACTATTAATAGTTGGTTGGCCTGG | SEQ ID 1310 | GGTGCTTCCACCAGGGCCACTGGC | SEQ ID 1375 | CAAAGTATACAGCTTCCGTGGACGTTC |
| SEQ ID 1237 | GCAAGTCAGGGCATTAGAAATGATTTAGGCTGG | SEQ ID 1311 | GGTGCATCCAGTTTGCAAAGTGGA | SEQ ID 1376 | CAATATAATAGTTATTCTCCCACTTTT |
| SEQ ID 1238 | GCAAGTCAGAGCATTAGCAGCTATTTAAATTGG | SEQ ID 1312 | GCTGCATCCAGTTTGCACACTGGG | SEQ ID 1377 | CACTATGGTCCCTCACGTCGGATCACCTTC |

TABLE 8-continued

Light Chain CDR DNA Sequences

| SEQ ID | CDRL1 DNA Seq | SEQ ID | CDRL2 DNA Seq | SEQ ID | CDRL3DNASeq |
|---|---|---|---|---|---|
| SEQ ID 1239 | TCCAGCCAGAGTGTTTTATACAGCTCCAACAATAAGAACTACATAGCTTGG | SEQ ID 1313 | GCTGCATCCACTTTGCAAAGTGGG | SEQ ID 1378 | CAGCATAATTCCTACCCTCGAACATTC |
| SEQ ID 1240 | GCCAGTCAGGGCATTAGCAGTTCTTTGGCCTGG | SEQ ID 1314 | GCTGCATCCACCAGGGCCACTGGT | SEQ ID 1379 | CAGAGTTACAGTATTCCTCGAACGTTC |
| SEQ ID 1241 | GCCAGTGAGAGTGTTAATAGCAACTTCTTAGCCTGG | SEQ ID 1315 | GGTGCCTCCAGCAGGGCCGCTGGC | SEQ ID 1380 | CAATATTATTATATTCCTCGGACGTTC |
| SEQ ID 1242 | GCCAGTCAGAGTGTTGGCAGCAAATTAGCCTGG | SEQ ID 1316 | GCTGCATCCTACAGGGCCACTGGC | SEQ ID 1381 | CAGTATGGTAGCTCATCCATGTACACTTTT |
| SEQ ID 1243 | GCCAGTCAGAATGTTTACAGCAATTTCTTAGCCTGG | SEQ ID 1317 | AAGGTTTCTAACCGGTTGTCTGGG | SEQ ID 1382 | CAGTATGATAATCTCCCTCCTCTCACTTTC |
| SEQ ID 1244 | TCTAGTCAAAGTCTCGAACACGGTGATGGAAACACGTACTTGAGTTGG | SEQ ID 1318 | GATGCATCCACCAGGGCCACTGGT | SEQ ID 1383 | CAGTATAATAACTGGCCGCTCACTTTC |
| SEQ ID 1245 | TCTAGTCAGAGCCTCCTGCATAGTAATGGAAACAACTATTTGGATTGG | SEQ ID 1319 | GGTACATCCACCAGGGCCACTGGT | SEQ ID 1384 | CAGTATAATAGTTATTCGGGGACGTTC |
| SEQ ID 1246 | GCCAGTCAGAGTATTAGCAACAACTTAGCCTGG | SEQ ID 1320 | GGTGCATCCAGGAGGGCCACTGGC | SEQ ID 1385 | CAGTATAATAACTGGCCCCCGATCACCTTC |
| SEQ ID 1247 | GCCAGTCAGAGTGTTAGCAGCACCTCCTTAGCCTGG | SEQ ID 1321 | AAGATTTCTAACCGGTTCTCTGGG | SEQ ID 1386 | CAATATGGAACCTCACCGATCACCTTC |
| SEQ ID 1248 | TCTAGTCAAAGCCTCGTATACAGTGATGGAAACACCTACTTGAGTTGG | SEQ ID 1322 | GATGCATCCACCAGGGCCACGGGA | SEQ ID 1387 | CAGTATAATAACTGGCCTCCCATCACCTTC |
| SEQ ID 1249 | TCTAATCAAAGCCTCGTATACAGTGATGGAGGCACCTACTTGAATTGG | SEQ ID 1323 | AAGGTTTCTAAGCGGGACTCTGGG | SEQ ID 1388 | CAAGGTATATACTGGCCTCGAACCTTC |
| SEQ ID 1250 | TCCAGCCAGAGTGTTTTATACAGAACCAACAATAAGAACTACTTGGCTTGG | SEQ ID 1324 | GACTCCAACAGGGCCACTGGC | SEQ ID 1389 | CAGCGTAGCAACTGGTCGCTCACTTTC |
| SEQ ID 1251 | GCCAGTCAGAGCATTGGGAGCAATTTAGCCTGG | SEQ ID 1325 | GAAGTTTCCAACCGGTTCTCTGGA | SEQ ID 1390 | CAAGGTCTACAAATCCCTATCACTTTC |
| SEQ ID 1252 | TCTAGTCAAAGCCTCGTGTACAGTGATGGAAACACCTACTTGTATTGG | SEQ ID 1326 | GGTGCCTCCACCAGGGCCACTGCT | SEQ ID 1391 | CACTATAATAACTGGCCTCATACCTTC |
| SEQ ID 1253 | GCCAGTCAGAGTGTTAGAGACAACGTAGGTTGG | SEQ ID 1327 | GCTGCCTCCACCAGGGCCACTGGT | SEQ ID 1392 | CAGTATGGTAGCTCGTTC |
| SEQ ID 1254 | GCCAGTCAGACTATTGGTCCCAAGTCCTTCGGCTGG | SEQ ID 1328 | TTGGGTTCTAATCGGGCCTCCGGG | SEQ ID 1393 | CAGTATAATTTCTGGCCTTCGATCACCTTC |
| SEQ ID 1255 | TCTAGTCAGAGCCTCCTGCATAGTGATGGAAAGACCTATTTGTATTGG | SEQ ID 1329 | GGTGCATCCTACAGGGCCACTGGC | SEQ ID 1394 | CACTATGGTAGTTCACCTCCAATCACCTTC |
| SEQ ID 1256 | GCCAGTCAGAGTGTTAGTAGCAGCTTAGCCTGG | SEQ ID 1330 | AGTGCAACCTCTAGGGCCACTGGA | SEQ ID 1395 | CAAGGTACACAATTTCCTCAAACGTTC |
| SEQ ID 1257 | GCCAGTGAAGGTCTTACCACCAACTTAGCCTGG | SEQ ID 1331 | AAGGTTTCTACCCGGTTCTCTGGG | SEQ ID 1396 | CAAGGGACACACTGGCCGTACACTTTT |
| SEQ ID 1258 | GCCAGTCAGAGTGTTAGCACCCTCTTAGCCTGG | SEQ ID 1332 | GCTGCATCCAGTTTGCAAAGTGGG | SEQ ID 1397 | CAATATTACAATCTTCCTCGATCTTTT |
| SEQ ID 1259 | GCCAGTCAGAGTGTTTTCAACAACTACTTAGCCTGG | SEQ ID 1333 | GCTGCCTCCAATCTGCACAGTGGC | SEQ ID 1398 | CAGCATGGTGAATGGCCCACCTTC |
| SEQ ID 1260 | TCTAGTCAAAGCCTCGTATACAGTGATGGAAACACCTACTTGAATTGG | SEQ ID 1334 | GATGTATCCACCAGGGCCACTGAT | SEQ ID 1399 | CAAGGTAGACACTGGCCGTACACTCTT |
| SEQ ID 1261 | TCTAGTCAGAGCCTCCTACATAGTAGTGGATACAACTATTTGGATTGG | SEQ ID 1335 | AAGGCGTCTACTATAAAAGTGGG | SEQ ID 1400 | CAGTTTAATAATTGGCCTTACACTTTT |
| SEQ ID 1262 | TCTAGTCAGAGCCTCCTGAATAGTAATGGATACAACTATTTGGAGTGG | SEQ ID 1336 | GCTGCGTCCAATTTGCAAAGTGGG | SEQ ID 1401 | CAGCGTAGCAGGTGGCCTCTCACTTTC |

TABLE 8-continued

Light Chain CDR DNA Sequences

| SEQ ID | CDRL1 DNA Seq | SEQ ID | CDRL2 DNA Seq | SEQ ID | CDRL3DNASeq |
|---|---|---|---|---|---|
| SEQ ID 1263 | GCCAGTCAGAGTGTTACCAGCAACTACTTAGCCTGG | SEQ ID 1337 | TGGGCATCTACCCGGGAATCCGGG | SEQ ID 1402 | CAAAGTATACAGCTTCCGCTCACTTTC |
| SEQ ID 1264 | GCCAGTCAGAGTGTTAGCAGCAGCTCCTTAGCCTGG | SEQ ID 1338 | GGTGCATCCACCAGGGCCACTGGC | SEQ ID 1403 | CAGTATGGTAGCTCACCCCCGGGCACTTTC |
| SEQ ID 1265 | GCCAGTCAGAGTATTGGCAGCAACTTAGTCTGG | SEQ ID 1339 | AAGGCGTCTACTTTAGCAAATGGG | SEQ ID 1404 | CGCTATGATAACTGGCTCCCCTTTTT |
| SEQ ID 1266 | TCTAGTCAAAGCCTCGAACACACTGATGGAAACACCTACTTAAGTTGG | SEQ ID 1340 | GGTGCATCCACCAGGGCCAGTGGC | SEQ ID 1405 | CAGTATAATCACTGGCTCTCTACACTTTT |
| SEQ ID 1267 | GCAAGTCAGAGCATTAGCAACTATTTAAATTGG | SEQ ID 1341 | GATTCATCCAGCAGGGCCACTGGC | SEQ ID 1406 | CAGGGTAGCAACTGGCCGCTCACTTTC |
| SEQ ID 1268 | CCAAGTCAGGACATAGGCACTTATTTAAATTGG | SEQ ID 1342 | GGTGCATCCAACAGGGCCACTGGT | SEQ ID 1407 | CAAGGTACACACTGGCCTCGAACGTTC |
| SEQ ID 1269 | GCCAGTCAAAGTGTTAACAGCAACGTAGCCTGG | SEQ ID 1343 | GATGCATCCAGCAGGGCCACTGGC | SEQ ID 1408 | CACCGTTACGTGTGGCCGTTCACTTTC |
| SEQ ID 1270 | GCCAGTCAGAGTGTTGGTACCAATTTAGCCTGG | SEQ ID 1344 | GATTCATCGAATAGGGCCACTGGC | SEQ ID 1409 | CAGTATGGTAGTTCACCGATCACCTTC |
| SEQ ID 1271 | GCCAGTCAGAGTATTAGTAGGTGGTTGGCCTGG | SEQ ID 1345 | GGTGCATCCAGCAGGGCCTCTGGC | SEQ ID 1410 | CAAGGTACACATTGGCCTCGGACTTTC |
| SEQ ID 1272 | GCGAGTCAGAACATTCGCCACTGGTTAGTCTGG | SEQ ID 1346 | TGGGCGTCTACCCGGGGGTCCGGG | SEQ ID 1411 | CAAGGTCTACAAATTCCGCTCACTTTC |
| SEQ ID 1273 | TCCAGCCGGAATATTTTATACAGCGGCAACAATAAAAACTTCTTGGCTTGG | SEQ ID 1347 | AAGGTTTCTAACCGGGACTCTGGG | SEQ ID 1412 | CAGTCTCTACAAACTCCTCTCACTTTC |
| SEQ ID 1274 | GCCAGTCAGAGTATTAGCAGCACCTACTTAGCCTGG | SEQ ID 1348 | GGTGCATCCAGCAGGGCCACTGAC | SEQ ID 1413 | CAGTATGCTAGCTCAGTCACCTTC |
| SEQ ID 1275 | GCCAGGCAGAGCATCAGTAACCGGTTGGCCTGG | SEQ ID 1349 | TATGCTTCCCAGTCCTTCTCAGGG | SEQ ID 1414 | CAGTATAATAACTGGCCTCCCTTCACCTTC |
| SEQ ID 1276 | GCCAGTGAGAGTGTTAGCAAGAGCTACTTACTCTGG | SEQ ID 1350 | TGGGCATCTGCCCGGGAATCCGGG | SEQ ID 1415 | CAGTATGGTAGCTCACAGACCTTC |
| SEQ ID 1277 | GCCAGTCAGAGTGTTAGCAGCAGCGCCTTAGCCTGG | SEQ ID 1351 | GGTGCCTCCACCAGGGCCACTGGT | SEQ ID 1416 | CAGTATGGTAGTTCACCTCCGACCACCTTC |
| SEQ ID 1278 | GCCAGTCAAAGTGTTACCAGCAACTTAGCCTGG | SEQ ID 1352 | GAGGTTTCTAAGCGGGACTCTGGG | SEQ ID 1417 | CAGCGTAGCAACTGGCCGTGGACGTTC |
| SEQ ID 1279 | GCCAGTCAGAGTATTGGCACTTACGTCGCCTGG | SEQ ID 1353 | GAAGTTTCCAACCGATTCTCTGGA | SEQ ID 1418 | CAGGCTACACACTATCCTCGGACGTTC |
| SEQ ID 1280 | GCCAGTCAGAGTGTTAGCAGCAACTCCTTAGCCTGG | SEQ ID 1354 | GCTTCATCTACTTTGCAATCAGGG | SEQ ID 1419 | CAGAGTTACATTACCCCGTGGACGTTC |
| SEQ ID 1281 | TCCAGCCAGAGTGTTTTATATGATTCCAACAGTAAGAACTACTTAAGTTGG | SEQ ID 1355 | AAGGCCTCTAGTTTAACAAGTGGG | SEQ ID 1420 | CAGAGTTACGGTCCTCGGACATTC |
| SEQ ID 1282 | GCCAGTCAGAGTGTTAGTAGCTACTTAGCCTGG | SEQ ID 1356 | AAGGCGTCTAGTTTAGAAAGTGGG | SEQ ID 1421 | CAGTGTGCTAGCTCACCTCCTGTCACTTTC |
| SEQ ID 1283 | TCTTGTCAAAGCCTCGTATACAGTGATGGCAACACCTACTTGAATTGC | SEQ ID 1357 | TTGGGTTCTACTCGGGCCTCCGGG | SEQ ID 1422 | CAGTATAATAACTGGCCTCCGATAACTTTC |
| SEQ ID 1284 | GCCAGTCAGAGTGTTAGCAGCAGCTACTTAGGCTGG | SEQ ID 1358 | GGTGTTTCCACCAGGGCCACTGGC | SEQ ID 1423 | CACTATAAAAGTGATTCCCGGACGTTC |
| SEQ ID 1285 | GCCAGTCAGAGCATTGGTGGTAGCTTACACTGG | SEQ ID 1359 | ACTGCATCCAAAGGGCCACTGGC | SEQ ID 1424 | CAGCATAACAGTTACCGTGGACGTTC |
| SEQ ID 1286 | TCCAGCCAGAGTGTTTTATACAGCTCCAACAATAAGAACTACTTAGCTTGG | SEQ ID 1360 | ATGGGTTCTAGTCGGGCCTCCGGG | SEQ ID 1425 | CAATATTATAGTACTCCGCTCACTTTC |
| SEQ ID 1287 | GCCAGTCAGAGTATTAGCAGCAACTTAGCCTGG | SEQ ID 1361 | GGTGCATCCAGCAGGGCCACTGGC | SEQ ID 1426 | CAGTATGGTAGCTCACTCCTCTTC |

TABLE 8-continued

Light Chain CDR DNA Sequences

| SEQ ID | CDRL1 DNA Seq | SEQ ID | CDRL2 DNA Seq | SEQ ID | CDRL3DNASeq |
|---|---|---|---|---|---|
| SEQ ID 1288 | TCTAGTCATAGCCTCACAACTACTGATGGACGTACTTACGTGGCTTGG | SEQ ID 1362 | GGTGCATCCACCAGGGCCACTGGT | SEQ ID 1427 | CAGAGTAGTAGTTTACCTCACACTTTC |
| SEQ ID 1289 | TCTAGTCAGAGCCTCCTGGGTGGTGATGGAAAGACCTATTTGTATTGG | SEQ ID 1363 | GAGGTTTCTAACCGGGACTCTGGT | SEQ ID 1428 | CAGTATGGTAACTCACCTCCGGGAGCCACCTTC |
| SEQ ID 1290 | GCGAGTCAGGGCATTGCCAATTATTTAGCCTGG | SEQ ID 1364 | GGCGCATCCAACAGGGCCACAGGC | SEQ ID 1429 | CAGTATCAAAGTTACTGGACGTTC |
| SEQ ID 1291 | GCCAGTCAGAGTATTACTACCTGGTTGGCCTGG | SEQ ID 1365 | GATGCGTCCAGCAGGGCCGAAGGC | SEQ ID 1430 | CACTATGGCAGCTCTCGCACCTTC |
| SEQ ID 1292 | GCCAGTCAGAGTATTAGTAGCTGGTTGGCCTGG | SEQ ID 1366 | CGTGCATCCAGCAGGGCCACTGGC | SEQ ID 1431 | CAGTTTAATACCTACCCCAACACTTTT |
| SEQ ID 1293 | GCCAGTCAGAGTGTTAATAGCGGCTACTTAGCCTGG | SEQ ID 1367 | TCTACATCGACTTTACAAAGTGGA | SEQ ID 1432 | CAGTATGGTAGCTCACCTGCGCTCACTTTC |
| SEQ ID 1294 | GCCAGTCACAGTGTTGGCGCCAACTACATAGCCTGG | SEQ ID 1368 | TGGGCATCTACCCGGGACTCCGGG | SEQ ID 1433 | CAGTATGGTAGTCCACCTCCGACCACCTTC |
| SEQ ID 1295 | TCTAGTCAGAGCCTCCTGCATAGTAATGGATACAACTATTTGGATTGG | SEQ ID 1369 | GATGCATCCAACAGGGCCACTGGC | SEQ ID 1434 | CAGTATGGTAGCTCACCTCGGGTCACTTTC |
| SEQ ID 1296 | GCCAGTCAGAGTGTTAGCAGCAACTTAGCCTGG | SEQ ID 1370 | CGTGCATCCACCAGGGCCGCTGGT | SEQ ID 1435 | CAGCGTGCCGAGTGGCCTCTCACCTTC |
| SEQ ID 1297 | GCCAGTCAGAGTGTAATAAGCAGGTACTTAGCCTGG | SEQ ID 1371 | GATGCATCCAATTTGGAAACAGGG | SEQ ID 1436 | CAGTATGGTAGCTCACGTCGGACGTTC |
| SEQ ID 1298 | TCTAGTCAAAGCCTCGTACACAGTAATGGACACACCTACTTGAGTTGG | SEQ ID 1372 | TTGGGTTCTAATCGGGCCCCCGGG | SEQ ID 1437 | CAGTATGGTAGCTCAGGGTACACTTTT |
| SEQ ID 1299 | GCCAGTCAGAGTGTTAGCAGCAGCTACTTAGCCTGG | | | SEQ ID 1438 | CAGTATGGTAACTCACAGACCTTC |
| SEQ ID 1300 | GCCAGTCAGAGTTTAAGTACCAACTTAGCCTGG | | | SEQ ID 1439 | CAATTTTATGGTATTCCCCACTTC |
| SEQ ID 1301 | GCCAGTCAGAGTATTAGCGGCAGTTACTTAGCCTGG | | | SEQ ID 1440 | AAGTATAACAGTCCCCCTCGGACGTTC |
| SEQ ID 1302 | GCCAGTCAGAGTCTTACCAGCAGCTACTTAGCCTGG | | | SEQ ID 1441 | CAAGGTCTACAAACTCCATTCACTTTC |
| SEQ ID 1303 | TCCAGCCAGGCCCTGCAAATGTTGTCGGCCTTGGCGATGATTTAGCCTGG | | | SEQ ID 1442 | CAGCGTAGCAACTGGCCTTTCTTC |
| SEQ ID 1304 | TCCAACCGGAGTGTTTTATACAGCCCCAACAATCAGAACTACTTAGGTTGG | | | SEQ ID 1443 | CAGTATGGTATCTCACCTCTCGCGTTC |
| SEQ ID 1305 | GCCAGTCAGAGTGTTAGCAGCTACTTAGCCTGG | | | SEQ ID 1444 | CAGAGTATCAGTTTACCGCTCACTTTC |
| SEQ ID 1306 | GCCAGTCAGAGTGTTGGCAGCGACTTAGCCTGG | | | SEQ ID 1445 | CAATTTTATAGTCCTCCTCGGACGTTC |
| SEQ ID 1307 | GCCAGTCAGAGTATTAGTAGCTGCTTGGCCTGG | | | SEQ ID 1446 | CAGTATAATAACTGGCCTAGAACGTTC |
| | | | | SEQ ID 1447 | CAAGGAACACATGGGCCTCACACGTTC |
| | | | | SEQ ID 1448 | CAATCTACACAATTTCCGTGGACGTTC |
| | | | | SEQ ID 1449 | AAGTATAACAGTGTCCCTCTCACTTTC |
| | | | | SEQ ID 1450 | CATTATAATGGTGCTTCTCGTATGTTC |
| | | | | SEQ ID 1451 | CAGTATAATAGTTATTGGACGTTC |

TABLE 8-continued

Light Chain CDR DNA Sequences

| SEQ ID | CDRL1 DNA Seq | SEQ ID | CDRL2 DNA Seq | SEQ ID | CDRL3DNASeq |
|---|---|---|---|---|---|
| | | | | SEQ ID 1452 | CAAGCTCTACACACTCCGT GGACGTTC |
| | | | | SEQ ID 1453 | CAGTATAATAGTTATTCAA GGACGTTC |
| | | | | SEQ ID 1454 | CAGTATGGTAGCTCACTC AGGTACACTTTT |
| | | | | SEQ ID 1455 | CAGTATAATAACTGGCCT CGGTTC |
| | | | | SEQ ID 1456 | GAGTATGGTAACTCAGCT ATGTACAATTTT |
| | | | | SEQ ID 1457 | CAGTATAATAACTGGCCT CTCACTTTC |
| | | | | SEQ ID 1458 | CAGTATGCTGCCGCACCG ATTACCTTC |
| | | | | SEQ ID 1459 | CAAACTTTACACACTGTCA CTTTC |
| | | | | SEQ ID 1460 | CAGTATGGTAGCTCACCC CGGATCACCTTC |
| | | | | SEQ ID 1461 | CAGTATAATAACTGGCCC CGGACGTTC |
| | | | | SEQ ID 1462 | CAGTATAATAACTGGCCT CCTATGTACACTTTT |
| | | | | SEQ ID 1463 | CAGTATGGTAGCTCACCTC CGTACACTTTT |
| | | | | SEQ ID 1464 | CAAACTCTTCAAACTCCGC TCACTTTC |
| | | | | SEQ ID 1465 | CAAGGAACACACTGGCCC CCCCTCACTGTC |
| | | | | SEQ ID 1466 | CAGTATGGAAGCTCACCG GGAACGTTC |
| | | | | SEQ ID 1467 | CAGTATCATAACTGGCCTC CGTACACTTTT |
| | | | | SEQ ID 1468 | CAATATTATAGTAGTACTC CGTACACTTTT |
| | | | | SEQ ID 1469 | CAGTATGGTAGCTCACCA ATATTCACTTTC |
| | | | | SEQ ID 1470 | CAGTATGGTAGTTCACCTA ACACCTTC |
| | | | | SEQ ID 1471 | CAGCACCATGATTTCCCTT TCACTTTC |
| | | | | SEQ ID 1472 | CAGCGTTACAACTGGCCT ATCACCTTC |
| | | | | SEQ ID 1473 | CAATATGCAAGTACTCCA TACACTTTT |
| | | | | SEQ ID 1474 | CAGCGTAGCAACTGGCCT CGGACGTTC |
| | | | | SEQ ID 1475 | CAGTATGGTAGATCACCG TACACTTCT |
| | | | | SEQ ID 1476 | CAGTTTGATAATGTCCCAG TCACTTTC |

TABLE 8-continued

Light Chain CDR DNA Sequences

| SEQ ID | CDRL1 DNA Seq | SEQ ID | CDRL2 DNA Seq | SEQ ID | CDRL3DNASeq |
|--------|---------------|--------|---------------|--------|-------------|
|        |               |        |               | SEQ ID 1477 | CAGCTTAATAGTTACCCTC AGACGTTC |
|        |               |        |               | SEQ ID 1478 | CAAGCTCTACAAACTCCG TACACTTTT |
|        |               |        |               | SEQ ID 1479 | CAGTATAATAACTGGCCT CCGATCACCTTC |
|        |               |        |               | SEQ ID 1480 | CAAGCTCTACAAACTCGG ACATTC |

In some embodiments, a nucleotide sequence encoding an antibody, antibody fragment, VH domain, VL domain or CDR of the disclosure is a wild type sequence. In some embodiments, the nucleotide sequence is codon optimized for expression in mammalian cells. In some embodiments, the nucleotide sequence is codon optimized for expression in human cells.

Figure 1B:
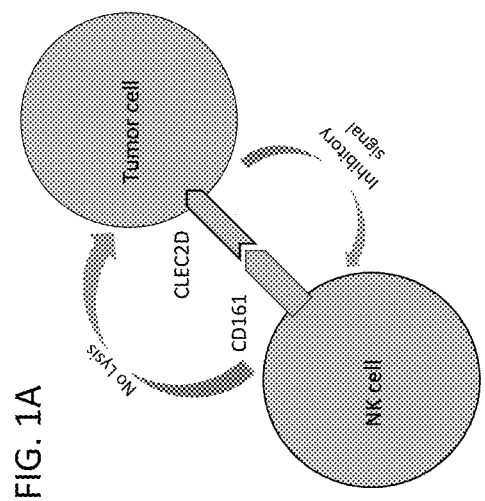
Figure 1C:
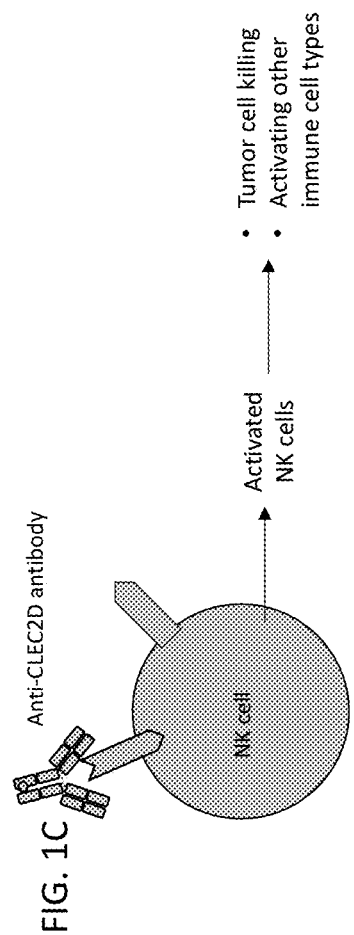

In some embodiments, the invention relates to an antibody that is capable of binding to CLEC2D and that blocks the interaction between CLEC2D and CD161 (FIG. 1). In some embodiments, the anti-CLEC2D antibody as disclosed herein, is a monoclonal antibody. In some embodiments, the anti-CLEC2D antibody as disclosed herein, is a polyclonal antibody.

In some embodiments, the invention relates to an antibody that is capable of binding to CLEC2D and that blocks the interaction between CLEC2D and CD161, which is capable of removing CLEC2D-expressing cells by means of antibody-dependent cell-mediated cytotoxicity (ADCC) and/or by complement-dependent cytotoxicity (CDC). In some embodiments, the invention relates to an antibody that is capable of binding to CLEC2D and that blocks the interaction between CLEC2D and CD161, that is capable of stimulating the cytokine production and the cytotoxicity mediated by NK cells.

In some embodiments, the anti-CLEC2D antibody as disclosed herein, is a humanized antibody. In some embodiments, the anti-CLEC2D antibody as disclosed herein, is of human IgG1, IgG1 N296A, IgG2, IgG3 or IgG4 isotype. In some embodiments, the anti-CLEC2D antibody is a mouse IgG1, IgG2a, IgG2b or IgG3 isotype.

In some embodiments, an anti-CLEC2D antibody as disclosed herein, comprises a variable heavy chain (VH) comprising an amino acid sequence having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to an amino acid sequence selected from the group consisting of SEQ ID NOs: 1-108.

In some embodiments, an anti-CLEC2D antibody as disclosed herein, comprises a variable light chain (VL) comprising an amino acid sequence having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to an amino acid sequence selected from the group consisting of SEQ ID NOs. 217-324.

In some embodiments, an anti-CLEC2D antibody as disclosed herein, comprises a variable heavy chain (VH) comprising an amino acid sequence having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to an amino acid sequence selected from the group consisting of SEQ ID NOs: 1-108; and a variable light chain (VL) comprising an amino acid sequence having at least 50% identity, at least 55% identity, at least 60% identity, at least 65% identity, at least 70% identity, at least 75% identity, at least 80% identity, at least 85% identity, at least 90% identity, at least 91% identity, at least 92% identity, at least 93% identity, at least 94% identity, at least 95% identity, at least 96% identity, at least 97% identity, at least 98% identity, at least 99% identity, at least 99.5% identity, at least 99.8% identity, at least 99.9% identity or 100% identity to an amino acid sequence selected from the group consisting of SEQ ID NOs: 217-324.

In some embodiments, an anti-CLEC2D antibody as disclosed herein, comprises a variable heavy chain (VH) comprising an amino acid sequence encoded by a nucleic acid selected from the group consisting of SEQ ID NOs: 109-216.

In some embodiments, an anti-CLEC2D antibody as disclosed herein, comprises a variable light chain (VL) comprising an amino acid sequence encoded by a nucleic acid selected from the group consisting of SEQ ID NOs: 325-432.

In some embodiments, an anti-CLEC2D antibody as disclosed herein, comprises a variable heavy chain (VH) comprising an amino acid sequence encoded by a nucleic acid selected from the group consisting of SEQ ID NOs: 109-216; and a variable light chain (VL) comprising an amino acid sequence encoded by a nucleic acid selected from the group consisting of SEQ ID NOs: 325-432.

In some embodiments, an anti-CLEC2D antibody as disclosed herein, comprises a variable heavy chain (VH)

comprising an amino acid sequence selected from the group consisting of SEQ ID NOs: 1-108.

In some embodiments, an anti-CLEC2D antibody as disclosed herein, comprises a variable light chain (VL) comprising an amino acid sequence selected from the group consisting of SEQ ID NOs: 217-324.

In some embodiments, an anti-CLEC2D antibody as disclosed herein, comprises a variable heavy chain (VH) comprising an amino acid sequence selected from the group consisting of SEQ ID NOs: 1-108, and a variable light chain (VL) comprising an amino acid sequence selected from the group consisting of SEQ ID NOs: 217-324.

In some embodiments, an anti-CLEC2D antibody as disclosed herein, comprises a VH comprising an amino acid sequence according to SEQ ID NO 44 and a VL comprising an amino acid sequence according to SEQ ID NO: 260.

In some embodiments, an anti-CLEC2D antibody as disclosed herein, comprises a VH comprising an amino acid sequence according to SEQ ID NO:45, and a VL comprising an amino acid sequence according to SEQ ID NO:261.

In some embodiments, an anti-CLEC2D antibody as disclosed herein, comprises a VH comprising an amino acid sequence according to SEQ ID NO:42, and a VL comprising an amino acid sequence according to SEQ ID NO: 258.

In some embodiments, an anti-CLEC2D antibody as disclosed herein, comprises a VH comprising an amino acid sequence according to SEQ ID NO:1, and a VL comprising an amino acid sequence according to SEQ ID NO: 217.

In some embodiments, an anti-CLEC2D antibody as disclosed herein, comprises a VH comprising an amino acid sequence according to SEQ ID NO:73, and a VL comprising an amino acid sequence according to SEQ ID NO:289.

In some embodiments, an anti-CLEC2D antibody as disclosed herein, comprises a VH comprising an amino acid sequence according to SEQ ID NO:21, and a VL comprising an amino acid sequence according to SEQ ID NO:237.

In some embodiments, an anti-CLEC2D antibody as disclosed herein, comprises a VH comprising an amino acid sequence according to SEQ ID NO:35, and a VL comprising an amino acid sequence according to SEQ ID NO:251.

In some embodiments, an anti-CLEC2D antibody as disclosed herein, comprises a VH comprising an amino acid sequence according to SEQ ID NO:58, and a VL comprising an amino acid sequence according to SEQ ID NO: 274.

In some embodiments, an anti-CLEC2D antibody as disclosed herein, comprises a VH comprising an amino acid sequence according to SEQ ID NO:7, and a VL comprising an amino acid sequence according to SEQ ID NO:223.

In some embodiments, an anti-CLEC2D antibody as disclosed herein, comprises a Variable heavy chain (VH) complementarity determining region 1 (CDR1) comprising an amino acid sequence selected from the group consisting of SEQ ID NOs: 433-485.

In some embodiments, an anti-CLEC2D antibody as disclosed herein, comprises a Variable heavy chain (VH) complementarity determining region 2 (CDR2) comprising an amino acid sequence selected from the group consisting of SEQ ID NOs: 486-546.

In some embodiments, an anti-CLEC2D antibody as disclosed herein, comprises a Variable heavy chain (VH) complementarity determining region 3 (CDR3) comprising an amino acid sequence selected from the group consisting of SEQ ID NOs: 547-653.

In some embodiments, an anti-CLEC2D antibody as disclosed herein, comprises a variable light chain (VL) complementarity determining region 1 (CDR1) comprising an amino acid sequence selected from the group consisting of SEQ ID NOs: 654-726.

In some embodiments, an anti-CLEC2D antibody as disclosed herein, comprises a variable light chain (VL) complementarity determining region 2 (CDR2) comprising an amino acid sequence selected from the group consisting of SEQ ID NOs: 727-783.

In some embodiments, an anti-CLEC2D antibody as disclosed herein, comprises a variable light chain (VL) complementarity determining region 3 (CDR3) comprising an amino acid sequence selected from the group consisting of SEQ ID NOs: 784-885.

In some embodiments, an anti-CLEC2D antibody as disclosed herein, comprises a Variable heavy chain (VH) complementarity determining region 1 (CDR1) comprising an amino acid sequence selected from the group consisting of SEQ ID NOs: 433-485, a VH complementarity determining region 2 (CDR2) comprising an amino acid sequence selected from the group consisting of SEQ ID NOs: 486-546, and a VH complementarity determining region 3 (CDR3) comprising an amino acid sequence selected from the group consisting of SEQ ID NOs: 547-653.

In some embodiments, an anti-CLEC2D antibody as disclosed herein, comprises a Variable Light chain (VL) complementarity determining region 1 (CDR1) comprising an amino acid sequence selected from the group consisting of SEQ ID NOs: 654-726, a VL complementarity determining region 2 (CDR2) comprising an amino acid sequence selected from the group consisting of SEQ ID NOs: 727-783, and a VL complementarity determining region 3 (CDR3) comprising an amino acid sequence selected from the group consisting of SEQ ID NOs: 784-885.

In some embodiments, an anti-CLEC2D antibody as disclosed herein, comprises a variable heavy chain (VH) complementarity determining region 1 (CDR1) comprising an amino acid sequence selected from the group consisting of SEQ ID NOs: 433-485, a VH complementarity determining region 2 (CDR2) comprising an amino acid sequence selected from the group consisting of SEQ ID NOs: 486-546, and a VH complementarity determining region 3 (CDR3) comprising an amino acid sequence selected from the group consisting of SEQ ID NOs: 547-653; and a variable light chain (VL) complementarity determining region 1 (CDR1) comprising an amino acid sequence selected from the group consisting of SEQ ID NOs: 654-726, a VL complementarity determining region 2 (CDR2) comprising an amino acid sequence selected from the group consisting of SEQ ID NOs: 727-783, and a VL complementarity determining region 3 (CDR3) comprising an amino acid sequence selected from the group consisting of SEQ ID NOs: 784-885.

In some embodiments, an anti-CLEC2D antibody as disclosed herein, comprises a VH CDR1 comprising an amino acid sequence according to the SEQ ID NO: 439, a VH CDR2 comprising an amino acid according to the SEQ ID NO:492, and a VH CDR3 comprising an amino acid sequence according to the SEQ ID NOs: 589; and a VL CDR1 comprising an amino acid sequence according to SEQ ID NO: 687, a VL CDR2 comprising an amino acid sequence according to SEQ ID NOs: 729, and a VL CDR3 comprising an amino acid sequence according to SEQ ID NOs: 827.

In some embodiments, an anti-CLEC2D antibody as disclosed herein, comprises a VH CDR1 comprising an amino acid sequence according to the SEQ ID NO: 439, a VH CDR2 comprising an amino acid according to the SEQ ID NO: 492, and a VH CDR3 comprising an amino acid sequence according to the SEQ ID NOs: 590; and a VL CDR1 comprising an amino acid sequence according to SEQ ID 688, a VL CDR2 comprising an amino acid sequence according to SEQ ID 755, and a VL CDR3 comprising an amino acid sequence according to SEQ ID 828.

In some embodiments, an anti-CLEC2D antibody as disclosed herein, comprises a VH CDR1 comprising an amino acid sequence according to the SEQ ID 473, a VH CDR2 comprising an amino acid according to the SEQ ID 495, and a VH CDR3 comprising an amino acid sequence according to the SEQ ID 587; and a VL CDR1 comprising an amino acid sequence according to SEQ ID 655, a VL CDR2 comprising an amino acid sequence according to SEQ ID 732; and a VL CDR3 comprising an amino acid sequence according to SEQ ID 825.

In some embodiments, an anti-CLEC2D antibody as disclosed herein, comprises a VH CDR1 comprising an amino acid sequence according to the SEQ ID 433, a VH CDR2 comprising an amino acid according to the SEQ ID 486, and a VH CDR3 comprising an amino acid sequence according to the SEQ ID 547; and a VL CDR1 comprising an amino acid sequence according to SEQ ID 654, a VL CDR2 comprising an amino acid sequence according to SEQ ID 727, and a VL CDR3 comprising an amino acid sequence according to SEQ ID 784.

In some embodiments, an anti-CLEC2D antibody as disclosed herein, comprises a VH CDR1 comprising an amino acid sequence according to the SEQ ID 439, a VH CDR2 comprising an amino acid according to the SEQ ID 492, and a VH CDR3 comprising an amino acid sequence according to the SEQ ID 618; and a VL CDR1 comprising an amino acid sequence according to SEQ ID 678, a VL CDR2 comprising an amino acid sequence according to SEQ ID 730, and a VL CDR3 comprising an amino acid sequence according to SEQ ID 852.

In some embodiments, an anti-CLEC2D antibody as disclosed herein, comprises a VH CDR1 comprising an amino acid sequence according to the SEQ ID 446, a VH CDR2 comprising an amino acid according to the SEQ ID 501, and a VH CDR3 comprising an amino acid sequence according to the SEQ ID 567; and a VL CDR1 comprising an amino acid sequence according to SEQ ID 655, a VL CDR2 comprising an amino acid sequence according to SEQ ID 735, and a VL CDR3 comprising an amino acid sequence according to SEQ ID 804.

In some embodiments, an anti-CLEC2D antibody as disclosed herein, comprises a VH CDR1 comprising an amino acid sequence according to the SEQ ID 435, a VH CDR2 comprising an amino acid according to the SEQ ID 488, and a VH CDR3 comprising an amino acid sequence according to the SEQ ID 581; and a VL CDR1 comprising an amino acid sequence according to SEQ ID 680, a VL CDR2 comprising an amino acid sequence according to SEQ ID 782, and a VL CDR3 comprising an amino acid sequence according to SEQ ID 818.

In some embodiments, an anti-CLEC2D antibody as disclosed herein, comprises a VH CDR1 comprising an amino acid sequence according to the SEQ ID 466, a VH CDR2 comprising an amino acid according to SEQ ID 521, and a VH CDR3 comprising an amino acid sequence according to the SEQ ID 603; and a VL CDR1 comprising an amino acid sequence according to the SEQ ID 662, a VL CDR2 comprising an amino acid sequence according to the SEQ ID 732, and a VL CDR3 comprising an amino acid sequence according to the SEQ ID 814.

In some embodiments, an anti-CLEC2D antibody as disclosed herein, comprises a VH CDR1 comprising an amino acid sequence according to the SEQ ID 439, a VH CDR2 comprising an amino acid according to the SEQ ID 492, and a VH CDR3 comprising an amino acid sequence according to the SEQ ID 553; and a VL CDR1 comprising an amino acid sequence according to the SEQ ID 660, a VL CDR2 comprising an amino acid sequence according to the SEQ ID 733, and a VL CDR3 comprising an amino acid sequence according to the SEQ ID 790.

The disclosure provides an antibody library comprising at least about 108 unique monoclonal antibody clones, wherein at least about 80% of the antibody clones detectably and specifically bind a CLEC2D antigen. Various anti-CLEC2D antibodies with specific combinations of heavy chain, light chain, heavy chain CDRs 1-3 (i.e., CDRH1, CDRH2, and CDRH3) and Light chain CDRs 1-3 (i.e., CDRL1, CDRL2, and CDRL3), are described in Table 9A.

TABLE 9A

| Anti-CLEC2D antibody No. | SEQ ID code HC AA | SEQ ID HC DNA | SEQ ID LC AA SEQ ID | SEQ ID LC DNA | SEQ ID CDRH1 | SEQ ID CDRH2 | SEQ ID CDRH3 | SEQ ID CDRL1 | SEQ ID CDRL2 | SEQ ID CDRL3 |
|---|---|---|---|---|---|---|---|---|---|---|
| A1 | SEQ ID 44 | SEQ ID 152 | SEQ ID 260 | SEQ ID 368 | SEQ ID 439 | SEQ ID 492 | SEQ ID 589 | SEQ ID 687 | SEQ ID 729 | SEQ ID 827 |
| B1 | SEQ ID 45 | SEQ ID 153 | SEQ ID 261 | SEQ ID 369 | SEQ ID 439 | SEQ ID 492 | SEQ ID 590 | SEQ ID 688 | SEQ ID 755 | SEQ ID 828 |
| C1 | SEQ ID 75 | SEQ ID 183 | SEQ ID 291 | SEQ ID 399 | SEQ ID 453 | SEQ ID 507 | SEQ ID 620 | SEQ ID 700 | SEQ ID 760 | SEQ ID 854 |
| D1 | SEQ ID 77 | SEQ ID 185 | SEQ ID 293 | SEQ ID 401 | SEQ ID 439 | SEQ ID 492 | SEQ ID 622 | SEQ ID 706 | SEQ ID 769 | SEQ ID 856 |
| E1 | SEQ ID 42 | SEQ ID 150 | SEQ ID 258 | SEQ ID 366 | SEQ ID 473 | SEQ ID 495 | SEQ ID 587 | SEQ ID 655 | SEQ ID 732 | SEQ ID 825 |
| F1 | SEQ ID 56 | SEQ ID 164 | SEQ ID 272 | SEQ ID 380 | SEQ ID 433 | SEQ ID 486 | SEQ ID 601 | SEQ ID 662 | SEQ ID 754 | SEQ ID 838 |
| G1 | SEQ ID 64 | SEQ ID 172 | SEQ ID 280 | SEQ ID 388 | SEQ ID 469 | SEQ ID 525 | SEQ ID 609 | SEQ ID 655 | SEQ ID 735 | SEQ ID 844 |
| H1 | SEQ ID 50 | SEQ ID 158 | SEQ ID 266 | SEQ ID 374 | SEQ ID 456 | SEQ ID 512 | SEQ ID 595 | SEQ ID 692 | SEQ ID 759 | SEQ ID 833 |
| I1 | SEQ ID 43 | SEQ ID 151 | SEQ ID 259 | SEQ ID 367 | SEQ ID 473 | SEQ ID 49S | SEQ ID 588 | SEQ ID 686 | SEQ ID 754 | SEQ ID 826 |
| J1 | SEQ ID 80 | SEQ ID 188 | SEQ ID 296 | SEQ ID 404 | SEQ ID 437 | SEQ ID 506 | SEQ ID 625 | SEQ ID 708 | SEQ ID 771 | SEQ ID 859 |
| K1 | SEQ ID 33 | SEQ ID 141 | SEQ ID 249 | SEQ ID 357 | SEQ ID 454 | SEQ ID 510 | SEQ ID 579 | SEQ ID 655 | SEQ ID 735 | SEQ ID 816 |

TABLE 9A-continued

| Anti-CLEC2D antibody No. | SEQ ID code HC AA | SEQ ID HC DNA | SEQ ID LC AA | SEQ ID LC DNA | SEQ ID CDRH1 | SEQ ID CDRH2 | SEQ ID CDRH3 | SEQ ID CDRL1 | SEQ ID CDRL2 | SEQ ID CDRL3 |
|---|---|---|---|---|---|---|---|---|---|---|
| L1 | SEQ ID 23 | SEQ ID 131 | SEQ ID 239 | SEQ ID 347 | SEQ ID 439 | SEQ ID 492 | SEQ ID 569 | SEQ ID 670 | SEQ ID 744 | SEQ ID 806 |
| M1 | SEQ ID 24 | SEQ ID 132 | SEQ ID 240 | SEQ ID 348 | SEQ ID 448 | SEQ ID 504 | SEQ ID 570 | SEQ ID 656 | SEQ ID 729 | SEQ ID 807 |
| N1 | SEQ ID 59 | SEQ ID 167 | SEQ ID 275 | SEQ ID 383 | SEQ ID 461 | SEQ ID 516 | SEQ ID 604 | SEQ ID 696 | SEQ ID 742 | SEQ ID 840 |
| O1 | SEQ ID 74 | SEQ ID 182 | SEQ ID 290 | SEQ ID 398 | SEQ ID 474 | SEQ ID 530 | SEQ ID 619 | SEQ ID 705 | SEQ ID 743 | SEQ ID 853 |
| P1 | SEQ ID 1 | SEQ ID 109 | SEQ ID 217 | SEQ ID 325 | SEQ ID 433 | SEQ ID 486 | SEQ ID 547 | SEQ ID 654 | SEQ ID 727 | SEQ ID 784 |
| Q1 | SEQ ID 25 | SEQ ID 133 | SEQ ID 241 | SEQ ID 349 | SEQ ID 449 | SEQ ID 505 | SEQ ID 571 | SEQ ID 671 | SEQ ID 745 | SEQ ID 808 |
| R1 | SEQ ID 61 | SEQ ID 169 | SEQ ID 277 | SEQ ID 385 | SEQ ID 437 | SEQ ID 529 | SEQ ID 606 | SEQ ID 698 | SEQ ID 764 | SEQ ID 842 |
| S1 | SEQ ID 60 | SEQ ID 168 | SEQ ID 276 | SEQ ID 384 | SEQ ID 467 | SEQ ID 522 | SEQ ID 605 | SEQ ID 697 | SEQ ID 763 | SEQ ID 841 |
| T1 | SEQ ID 28 | SEQ ID 136 | SEQ ID 244 | SEQ ID 352 | SEQ ID 451 | SEQ ID 507 | SEQ ID 574 | SEQ ID 674 | SEQ ID 747 | SEQ ID 811 |
| U1 | SEQ ID 73 | SEQ ID 181 | SEQ ID 289 | SEQ ID 397 | SEQ ID 439 | SEQ ID 492 | SEQ ID 618 | SEQ ID 678 | SEQ ID 730 | SEQ ID 852 |
| V1 | SEQ ID 4 | SEQ ID 112 | SEQ ID 220 | SEQ ID 328 | SEQ ID 436 | SEQ ID 489 | SEQ ID 550 | SEQ ID 657 | SEQ ID 730 | SEQ ID 787 |
| W1 | SEQ ID 6 | SEQ ID 114 | SEQ ID 222 | SEQ ID 330 | SEQ ID 438 | SEQ ID 491 | SEQ ID 552 | SEQ ID 659 | SEQ ID 732 | SEQ ID 789 |
| X1 | SEQ ID 46 | SEQ ID 154 | SEQ ID 262 | SEQ ID 370 | SEQ ID 461 | SEQ ID 516 | SEQ ID 591 | SEQ ID 689 | SEQ ID 756 | SEQ ID 829 |
| Y1 | SEQ ID 21 | SEQ ID 129 | SEQ ID 237 | SEQ ID 345 | SEQ ID 446 | SEQ ID 501 | SEQ ID 567 | SEQ ID 655 | SEQ ID 735 | SEQ ID 804 |
| Z1 | SEQ ID 63 | SEQ ID 171 | SEQ ID 279 | SEQ ID 387 | SEQ ID 468 | SEQ ID 524 | SEQ ID 608 | SEQ ID 655 | SEQ ID 735 | SEQ ID 843 |
| A2 | SEQ ID 57 | SEQ ID 165 | SEQ ID 273 | SEQ ID 381 | SEQ ID 461 | SEQ ID 516 | SEQ ID 602 | SEQ ID 695 | SEQ ID 762 | SEQ ID 839 |
| B2 | SEQ ID 47 | SEQ ID 155 | SEQ ID 263 | SEQ ID 371 | SEQ ID 462 | SEQ ID 517 | SEQ ID 592 | SEQ ID 656 | SEQ ID 729 | SEQ ID 830 |
| C2 | SEQ ID 83 | SEQ ID 191 | SEQ ID 299 | SEQ ID 407 | SEQ ID 433 | SEQ ID 486 | SEQ ID 628 | SEQ ID 656 | SEQ ID 729 | SEQ ID 862 |
| D2 | SEQ ID 29 | SEQ ID 137 | SEQ ID 245 | SEQ ID 353 | SEQ ID 434 | SEQ ID 508 | SEQ ID 575 | SEQ ID 675 | SEQ ID 748 | SEQ ID 812 |
| E2 | SEQ ID 35 | SEQ ID 143 | SEQ ID 251 | SEQ ID 359 | SEQ ID 435 | SEQ ID 488 | SEQ ID 581 | SEQ ID 680 | SEQ ID 782 | SEQ ID 818 |
| F2 | SEQ ID 81 | SEQ ID 189 | SEQ ID 297 | SEQ ID 405 | SEQ ID 475 | SEQ ID 532 | SEQ ID 626 | SEQ ID 655 | SEQ ID 729 | SEQ ID 860 |
| G2 | SEQ ID 76 | SEQ ID 184 | SEQ ID 292 | SEQ ID 400 | SEQ ID 453 | SEQ ID 531 | SEQ ID 621 | SEQ ID 662 | SEQ ID 732 | SEQ ID 855 |
| H2 | SEQ ID 36 | SEQ ID 144 | SEQ ID 252 | SEQ ID 360 | SEQ ID 456 | SEQ ID 512 | SEQ ID 582 | SEQ ID 681 | SEQ ID 751 | SEQ ID 819 |
| I2 | SEQ ID 58 | SEQ ID 166 | SEQ ID 274 | SEQ ID 382 | SEQ ID 466 | SEQ ID 521 | SEQ ID 603 | SEQ ID 662 | SEQ ID 732 | SEQ ID 814 |
| J2 | SEQ ID 52 | SEQ ID 160 | SEQ ID 268 | SEQ ID 376 | SEQ ID 450 | SEQ ID 506 | SEQ ID 597 | SEQ ID 667 | SEQ ID 734 | SEQ ID 835 |
| K2 | SEQ ID 71 | SEQ ID 179 | SEQ ID 287 | SEQ ID 395 | SEQ ID 437 | SEQ ID 529 | SEQ ID 616 | SEQ ID 703 | SEQ ID 767 | SEQ ID 850 |
| L2 | SEQ ID 7 | SEQ ID 115 | SEQ ID 223 | SEQ ID 331 | SEQ ID 439 | SEQ ID 492 | SEQ ID 553 | SEQ ID 660 | SEQ ID 733 | SEQ ID 790 |
| M2 | SEQ ID 72 | SEQ ID 180 | SEQ ID 288 | SEQ ID 396 | SEQ ID 473 | SEQ ID 495 | SEQ ID 617 | SEQ ID 704 | SEQ ID 768 | SEQ ID 851 |
| N2 | SEQ ID 62 | SEQ ID 170 | SEQ ID 278 | SEQ ID 386 | SEQ ID 450 | SEQ ID 523 | SEQ ID 607 | SEQ ID 662 | SEQ ID 732 | SEQ ID 834 |

TABLE 9B

Germline information of selected anti-CLEC2D antibodies from Table 9A

| Anti-CLEC2D antibody No* (Selected Antibodies from Table 9A) | Variable Heavy chain Framework—Germline Family Information | Variable Light chain Framework—Germline Family Information |
|---|---|---|
| A1 | IGHV4; IGHD3; IGHJ2 | IGKV3; IGKJ4 |
| B1 | IGHV4; IGHD3; IGHJ5 | IGKV1; IGKJ1 |
| E1 | IGHV3; IGHD5; IGHJ4 | IGKV3; IGKJ5 |
| P1 | IGHV1; IGHD6; IGHJ4 | IGKV3; IGKJ5 |

TABLE 9B-continued

Germline information of selected anti-CLEC2D antibodies from Table 9A

| Anti-CLEC2D antibody No* (Selected Antibodies from Table 9A) | Variable Heavy chain Framework— Germline Family Information | Variable Light chain Framework— Germline Family Information |
|---|---|---|
| U1 | IGHV4; IGHD1; IGHJ4 | IGKV4; IGKJ4 |
| Y1 | IGHV5; IGHD5; IGHJ4 | IGKV3; IGKJ4 |
| E2 | IGHV1; IGHD5; IGHJ4 | IGKV1; IGKJ1 |
| I2 | IGHV6; IGHD1; IGHJ4 | IGKV3; IGKJ1 |
| L2 | IGHV4; IGHD3; IGHJ4 | IGKV1; IGKJ3 |

TABLE 9C

Amino acid and DNA sequence information of anti-CLEC2D antibodies formatted as IgG1, IgG4, IgG N2A and IgG2.

| Anti-CLEC2D No. * (Selected Antibodies from Table 9A and 9B) | IgG1 HC | IgG1 LC | IgG1 HC DNA | IgG1 LC DNA | IgG4 HC | IgG4 HC DNA | IgG N2A | IgG N2A DNA | IgG2 | IgG2 DNA |
|---|---|---|---|---|---|---|---|---|---|---|
| A1 | SEQ ID 1524 | SEQ ID 1632 | SEQ ID 1740 | SEQ ID 1848 | SEQ ID 1956 | SEQ ID 2064 | SEQ ID 2172 | SEQ ID 2280 | SEQ ID 2388 | SEQ ID 2496 |
| B1 | SEQ ID 1525 | SEQ ID 1633 | SEQ ID 1741 | SEQ ID 1849 | SEQ ID 1957 | SEQ ID 2065 | SEQ ID 2173 | SEQ ID 2281 | SEQ ID 2389 | SEQ ID 2497 |
| E1 | SEQ ID 1522 | SEQ ID 1630 | SEQ ID 1738 | SEQ ID 1846 | SEQ ID 1954 | SEQ ID 2062 | SEQ ID 2170 | SEQ ID 2278 | SEQ ID 2386 | SEQ ID 2494 |
| P1 | SEQ ID 1481 | SEQ ID 1589 | SEQ ID 1697 | SEQ ID 1805 | SEQ ID 1913 | SEQ ID 2021 | SEQ ID 2129 | SEQ ID 2237 | SEQ ID 2345 | SEQ ID 2453 |
| U1 | SEQ ID 1553 | SEQ ID 1661 | SEQ ID 1769 | SEQ ID 1877 | SEQ ID 1985 | SEQ ID 2093 | SEQ ID 2201 | SEQ ID 2309 | SEQ ID 2417 | SEQ ID 2525 |
| Y1 | SEQ ID 1501 | SEQ ID 1609 | SEQ ID 1717 | SEQ ID 1825 | SEQ ID 1933 | SEQ ID 2041 | SEQ ID 2149 | SEQ ID 2257 | SEQ ID 2365 | SEQ ID 2473 |
| E2 | SEQ ID 1515 | SEQ ID 1623 | SEQ ID 1731 | SEQ ID 1839 | SEQ ID 1947 | SEQ ID 2055 | SEQ ID 2163 | SEQ ID 2271 | SEQ ID 2379 | SEQ ID 2487 |
| I2 | SEQ ID 1538 | SEQ ID 1646 | SEQ ID 1754 | SEQ ID 1862 | SEQ ID 1970 | SEQ ID 2078 | SEQ ID 2186 | SEQ ID 2294 | SEQ ID 2402 | SEQ ID 2510 |
| L2 | SEQ ID 1487 | SEQ ID 1595 | SEQ ID 1703 | SEQ ID 1811 | SEQ ID 1919 | SEQ ID 2027 | SEQ ID 2135 | SEQ ID 2243 | SEQ ID 2351 | SEQ ID 2459 |

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of the anti-CLEC2D antibody No. A1, as disclosed in Table 9A. In some embodiments, an anti-CLEC2D antibody, as disclosed herein, comprises a combination of a heavy chain and a light chain, according to the amino acid sequence of the heavy chain and light chain of the anti-CLEC2D antibody No. A1, as disclosed in Table 9A. In some embodiments, the anti-CLEC2D antibody No. A1, as disclosed in Table 9B, comprises a variable heavy chain having a framework region sequence of the Germline gene families: IGHV4, IGHD3 and IGHJ2. In some embodiments, the anti-CLEC2D antibody No. A1, as disclosed in Table 9B, comprises a variable light chain having a framework region sequence of the Germline families: IGKV3 and IGKJ4.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. B1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. B1, as disclosed in Table 9A. In some embodiments, the anti-CLEC2D antibody No. B1, as disclosed in Table 9B, comprises a variable heavy chain having a framework region sequence of the Germline gene families: IGHV4, IGHD3 and IGHJ5. In some embodiments, the anti-CLEC2D antibody No. B1, as disclosed in Table 9B, comprises a variable light chain having a framework region sequence of the Germline families: IGKV1 and IGKJ1.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. C1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. C1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. D1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. D1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. E1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. E1, as disclosed in Table 9A. In some embodiments, the anti-CLEC2D antibody No. E1, as disclosed in Table 9B, comprises a variable heavy chain having a framework region sequence of the Germline gene families: IGHV3, IGHD5 and IGHJ4. In some embodiments, the anti-CLEC2D antibody No. E1, as disclosed in Table 9B, comprises a variable light chain having a framework region sequence of the Germline families: IGKV3 and IGKJ5.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. F1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. F1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. G1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. G1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. H1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. H1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. I1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. I1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. J1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. J1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. K1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. K1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. L1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. L1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. M1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. M1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. N1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. N1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. O1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. O1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. P1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. P1, as disclosed in Table 9A. In some embodiments, the anti-CLEC2D antibody No. P1, as disclosed in Table 9B, comprises a variable heavy chain having a framework region sequence of the Germline gene families: IGHV1, IGHD6 and IGHJ4. In some embodiments, the anti-CLEC2D antibody No. P1, as disclosed in Table 9B, comprises a variable light chain having a framework region sequence of the Germline families: IGKV3 and IGKJ5.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. Q1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. Q1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. R1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. R1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. S1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. S1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. T1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. T1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. U1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. U1, as disclosed in Table 9A. In some embodiments, the anti-CLEC2D antibody No. U1, as disclosed in Table 9B, comprises a variable heavy chain having a framework region sequence of the Germline gene families: IGHV4, IGHD1 and IGHJ4. In some embodiments, the anti-CLEC2D antibody No. U1, as disclosed in Table 9B, comprises a variable light chain having a framework region sequence of the Germline families: IGKV4 and IGKJ4.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. V1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. V1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. W1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. W1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. X1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. X1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. Y1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. Y1, as disclosed in Table 9A. In some embodiments, the anti-CLEC2D antibody No. Y1, as disclosed in Table 9B, comprises a variable heavy chain having a framework region sequence of the Germline gene families: IGHV5, IGHD5 and IGHJ4. In some embodiments, the anti-CLEC2D antibody No. Y1, as disclosed in Table 9B, comprises a variable light chain having a framework region sequence of the Germline families: IGKV3 and IGKJ4.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. Z1, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. Z1, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. A2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. A2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. B2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. B2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. C2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. C2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. D2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. D2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. E2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. E2, as disclosed in Table 9A. In some embodiments, the anti-CLEC2D antibody No. E2, as disclosed in Table 9B, comprises a variable heavy chain having a framework region sequence of the Germline gene families: IGHV1, IGHD5 and IGHJ4. In some embodiments, the anti-CLEC2D antibody No. E2, as disclosed in Table 9B, comprises a variable light chain having a framework region sequence of the Germline families: IGKV1 and IGKJ1.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. F2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. F2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. G2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. G2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. H2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. H2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. I2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. I2, as disclosed in Table 9A. In some embodiments, the anti-CLEC2D antibody No. I2, as disclosed in Table 9B, comprises a variable heavy chain having a framework region sequence of the Germline gene families: IGHV6, IGHD1 and IGHJ4. In some embodiments, the anti-CLEC2D antibody No. I2, as disclosed in Table 9B, comprises a variable light chain having a framework region sequence of the Germline families: IGKV3 and IGKJ1.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. J2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. J2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. K2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. K2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. L2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. L2, as disclosed in Table 9A. In some embodiments, the anti-CLEC2D antibody No. L2, as disclosed in Table 9B, comprises a variable heavy chain having a framework region sequence of the Germline gene families: IGHV4, IGHD3 and IGHJ4. In some embodiments, the anti-CLEC2D antibody No. L2, as disclosed in Table 9B, comprises a variable light chain having a framework region sequence of the Germline families: IGKV1 and IGKJ3.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. M2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. M2, as disclosed in Table 9A.

In some embodiments, an anti-CLEC2D antibody, as disclosed herein, comprises a combination of heavy chain CDRs 1, 2 and 3, and light chain CDRs 1, 2 and 3, according to the amino acid sequence of the heavy chain CDRs 1, 2 and 3, and light chain CDRs 1, 2 and 3 of anti-CLEC2D antibody No. N2, as disclosed in Table 9A. In some embodiments, an anti-CLEC2D antibody, as disclosed herein, comprises a combination of a heavy chain and a light chain, according to the amino acid sequence of the heavy chain and light chain of anti-CLEC2D antibody No. N2, as disclosed in Table 9A.

In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9A and B) comprise a human IgG1 Fc region or backbone. In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9A and B) comprise a human IgG4 Fc region or backbone. In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9A and B) comprise a human IgG1 N to A Fc region or backbone. In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9A and B) comprise a human IgG2 Fc region or backbone. In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9) is afucosylated. In some embodiments, any one or all of the anti-CLEC2D antibodies disclosed herein (e.g., including any one or all of Antibody Nos: A1, B1, E1, P1, U1, Y1, E2, I2 and L2, as disclosed in Table 9) comprises an afucosylated antibody region.

In some embodiments, any one or all of the anti-CLEC2D antibodies selected from the group consisting of Antibody Nos: A1, B1, E1, P1, U1, Y1, E2, I2 and L2, as disclosed in Table 9A and B, comprise a human IgG1 Fc region or backbone. In some embodiments, any one or all of the anti-CLEC2D antibodies selected from the group consisting of Antibody Nos: A1, B1, E1, P1, U1, Y1, E2, I2 and L2, as disclosed in Table 9C, comprise a human IgG4 Fc region or backbone. In some embodiments, any one or all of the anti-CLEC2D antibodies selected from the group consisting of Antibody Nos: A1, B1, E1, P1, U1, Y1, E2, I2 and L2, as disclosed in Table 9A and B, comprise a human IgG1 N to A Fc region or backbone. In some embodiments, any one or all of the anti-CLEC2D antibodies selected from the group consisting of Antibody Nos: A1, B1, E1, P1, U1, Y1, E2, I2 and L2, as disclosed in Table 9C, comprise a human IgG2 Fc region or backbone.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. A1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. B1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. E1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. P1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. U1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. Y1, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. E2, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. I2, as disclosed in Table 9C.

In some embodiments, an anti-CLEC2D antibody, as disclosed herein, comprises a combination of a heavy chain and a light chain, according to the amino acid sequence of the heavy chain and light chain of an IgG1 formatted anti-CLEC2D antibody No. L2, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. A1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. B1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. E1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. P1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. U1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. Y1, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. E2, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. I2, as disclosed in Table 9C.

In some embodiments, an anti-CLEC2D antibody, as disclosed herein, comprises a heavy chain, according to the amino acid sequence of the heavy chain of an IgG4 formatted anti-CLEC2D antibody No. L2, as disclosed in Table 9C.

In some embodiments, an anti-CLEC2D antibody, as disclosed herein, comprises an IgG N2A sequence, according to the amino acid sequence of the heavy chain of an IgG4 formatted anti-CLEC2D antibody No. L2, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. A1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. B1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. E1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. P1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. U1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. Y1, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. E2, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. I2, as disclosed in Table 9C.

In some embodiments, an anti-CLEC2D antibody, as disclosed herein, comprises a heavy chain, according to the amino acid sequence of the heavy chain of an IgG2 formatted anti-CLEC2D antibody No. L2, as disclosed in Table 9C.

In some embodiments, an anti-CLEC2D antibody, as disclosed herein, comprises an IgG N2A sequence, according to the amino acid sequence of the heavy chain of an IgG2 formatted anti-CLEC2D antibody No. L2, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. A1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. B1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. E1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. P1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. U1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. Y1, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. E2, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. I2, as disclosed in Table 9C.

In some embodiments, an anti-CLEC2D antibody, as disclosed herein, comprises a heavy chain, according to the amino acid sequence of the heavy chain of an IgG N2A formatted anti-CLEC2D antibody No. L2, as disclosed in Table 9C.

In some embodiments, an anti-CLEC2D antibody, as disclosed herein, comprises an IgG N2A sequence, according to the amino acid sequence of the heavy chain of an IgG N2A formatted anti-CLEC2D antibody No. L2, as disclosed in Table 9C.

In some embodiments, any one or all of the anti-CLEC2D antibodies selected from the group consisting of Antibody Nos: A1, B1, E1, P1, U1, Y1, E2, I2 and L2, as disclosed in Table 9A, 9B and 9C, is afucosylated. In some embodiments, any one or all of the anti-CLEC2D antibodies selected from the group consisting of Antibody Nos: A1, B1, E1, P1, U1, Y1, E2, I2 and L2, as disclosed in Table 9A, 9B and 9C, comprises an afucosylated antibody region.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence, that recognizes and binds to a human CLEC2D protein of amino acid sequence according to at least one of SEQ ID NOs: 886-920 and SEQ ID NOs: 930-1003.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence, that recognizes and binds to a human CLEC2D protein of amino acid sequence according to at least one of SEQ ID NOs: 886-909. In some embodiments, an anti-CLEC2D antibody or antibody fragment thereof, as disclosed herein, comprises a variable heavy chain sequence and a variable light chain sequence, that recognizes and binds to a human CLEC2D protein of amino acid sequence according to at least one of SEQ ID NOs: 930-1003.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence, that recognizes and binds to conformational epitope of CLEC2D antigen, comprises of amino acids positions either overlapping and/or non-overlapping with CD161 receptor interacting amino acid residues.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence, that inhibits or abrogates or competes with another antibody that recognizes and binds to conformational epitope of CLEC2D antigen, comprises of amino acids positions either overlapping and/or non-overlapping with CD161 receptor interacting amino acid residues.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that inhibits or abrogates or competes for, the binding of another antibody to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting non-linear scaffolds for CD161 receptor interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting non-linear scaffolds for CD161 receptor interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting non-linear scaffolds for CD161 receptor interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting allosteric and non-linear scaffolds for CD161 receptor non-interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting allosteric and non-linear scaffolds for CD161 receptor non-interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting allosteric and non-linear scaffolds for CD161 receptor non-interacting amino acid residues, thereby blocking the interaction between CLEC2D and CD161 receptors.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that when bound to CLEC2D selected from SEQ ID Nos: 886-920 and 930-1003, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that when bound to CLEC2D selected from SEQ ID Nos: 886-909 and 930-1003, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an anti-CLEC2D antibody selected from the group consisting of Antibody Nos: A1, B1, E1, P1, U1, Y1, E2, I2 and L2, as disclosed in Table 9A, 9B and 9C, comprises a variable heavy chain sequence and a variable light chain sequence that when bound to CLEC2D selected from SEQ ID Nos: 886-890, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an anti-CLEC2D antibody, as disclosed herein is deglycosylated. In some embodiments, a deglycosylated anti-CLEC2D antibody, as disclosed herein exhibits increased cytotoxicity towards a host cell, as compared to a glycosylated form of the same anti-CLEC2D antibody. In some embodiments, an anti-CLEC2D antibody, as disclosed herein comprised an N-linked glycosylation.

In some embodiments, an anti-CLEC2D antibody, as disclosed herein is afucosylated. In some embodiments, an afucosylated anti-CLEC2D antibody, as disclosed herein exhibits increased cytotoxicity towards a host cell, as compared to a fucosylated form of the same anti-CLEC2D antibody.

In some embodiments, an anti-CLEC2D antibody, as disclosed herein is sialylated. In some embodiments, a sialylated anti-CLEC2D antibody, as disclosed herein exhibits increased cytotoxicity towards a host cell, as compared to an unsialylated form of the same anti-CLEC2D antibody.

In some embodiments, an anti-CLEC2D antibody, as disclosed herein is hyper-galactosylated. In some embodiments, a hyper-galactosylated anti-CLEC2D antibody, as disclosed herein exhibits increased cytotoxicity towards a host cell, as compared to an un-galactosylated or low galactosylated form of the same anti-CLEC2D antibody.

In some embodiments, an anti-CLEC2D antibody, as disclosed herein is hyper-mannosylated. In some embodiments, a hyper-mannosylated anti-CLEC2D antibody, as disclosed herein exhibits increased cytotoxicity towards a host cell, as compared to a non-galactosylated or low mannosylated form of the same anti-CLEC2D antibody.

In some embodiments, the invention as disclosed herein, relates to a nucleic acid sequence encoding the amino acid sequence of the heavy chain CDRs 1, 2 and 3 of any of the anti-CLEC2D antibodies, as disclosed herein. In some embodiments, the invention as disclosed herein, relates to a nucleic acid sequence encoding the amino acid sequence of the light chain CDRs 1, 2 and 3 of any of the anti-CLEC2D antibodies, as disclosed herein.

In some embodiments, the invention as disclosed herein, relates to a nucleic acid sequence encoding the amino acid sequence of the variable heavy chain of any of the anti-CLEC2D antibodies, as disclosed herein. In some embodiments, the invention as disclosed herein, relates to a nucleic acid sequence encoding the amino acid sequence of the light chain of any of the anti-CLEC2D antibodies, as disclosed herein.

In some embodiments, the invention as disclosed herein, relates to a nucleic acid sequence encoding the amino acid sequence of the variable heavy chain CDRs 1, 2 and 3 of any of the anti-CLEC2D antibodies, as disclosed in Table 9A. In some embodiments, the invention as disclosed herein, relates to a nucleic acid sequence encoding the amino acid sequence of the variable light chain CDRs 1, 2 and 3 of any of the anti-CLEC2D antibodies, as disclosed in Table 9A.

In some embodiments, the invention as disclosed herein, relates to a nucleic acid sequence encoding the amino acid sequence of the variable heavy chain any of the anti-CLEC2D antibodies, as disclosed in Table 9A. In some embodiments, the invention as disclosed herein, relates to a nucleic acid sequence encoding the amino acid sequence of the variable light chain of any of the anti-CLEC2D antibodies, as disclosed in Table 9A.

In some embodiments, the invention as disclosed herein, relates to a nucleic acid sequence encoding the amino acid sequence of the variable heavy chain CDRs 1, 2 and 3 of any of the anti-CLEC2D antibodies, as disclosed in Table 9A. In some embodiments, the invention as disclosed herein, relates to a nucleic acid sequence encoding the amino acid sequence of the variable heavy chain of any of the anti-CLEC2D antibodies, as disclosed in Table 9A.

In some embodiments, the invention as disclosed herein, relates to a nucleic acid sequence encoding the amino acid sequence of the variable light chain CDRs 1, 2 and 3 of any of the anti-CLEC2D antibodies, as disclosed in Table 9A. In some embodiments, the invention as disclosed herein, relates to a nucleic acid sequence encoding the amino acid sequence of the variable light chain of any of the anti-CLEC2D antibodies, as disclosed in Table 9A.

In some embodiments, the invention as disclosed herein, relates to a nucleic acid sequence encoding the amino acid sequence of the heavy chain of the anti-CLEC2D antibodies, as disclosed in Table 9A, having a framework region sequence of the Germline families as disclosed herein. In some embodiments, the invention as disclosed herein, relates to a nucleic acid sequence encoding the amino acid sequence of the light chain of the anti-CLEC2D antibodies, as disclosed in Table 9A, having a framework region sequence of the Germline families as disclosed herein.

In some embodiments, the anti-CLEC2D antibody or antibody fragment thereof, as disclosed herein, can comprise a framework region sequence that is derived from or is a human, a murine, a rodent, a lagomorph, an equine, a bovine, an avian, a caprine, a porcine, a piscean, a canine or a feline framework germline family. In some embodiments, the anti-CLEC2D antibody or antibody fragment thereof, as disclosed herein, can comprise a framework region sequence that is derived from or is a human framework germline family.

In some embodiments, the invention as disclosed herein, relates to a vector carrying the nucleic acid encoding the amino acid sequences of an anti-CLEC2D antibody, as disclosed herein. In some embodiments, the invention as disclosed herein, relates to a vector carrying any one or all of the nucleic acid sequences encoding the amino acid sequences of an anti-CLEC2D antibody, as disclosed in Table 9A.

In some embodiments, the invention as disclosed herein, relates to a host cell transfected with a vector carrying the nucleic acid encoding the amino acid sequences of an anti-CLEC2D antibody, as disclosed herein. In some embodiments, the invention as disclosed herein, relates to relates to a host cell transfected with a vector carrying the nucleic acid sequences encoding the amino acid sequences of an anti-CLEC2D antibody, as disclosed in Table 9A.

In some embodiments, the anti-CLEC2D antibodies or antibody fragments thereof, as disclosed herein, can be conjugated to an agent, a chemical or a small molecule. In some embodiments, the agent is a therapeutic agent. In some embodiments, the therapeutic agent is a chemotherapeutic drug. In some embodiments, the therapeutic agent is a cytotoxic agent or drug. In some embodiments, the therapeutic agent is a radioisotope. In some embodiments, the agent is a diagnostic agent. In some embodiments, the diagnostic agent includes but is not limited to a fluorescent, chemiluminescent or radioisotopic dye or agent.

Epitope Recognition

Generally, the term "epitope" refers to the area or region on an antigen to which an antibody specifically binds, i.e., it is the area or region in physical contact with the antibody. A protein epitope may comprise amino acid residues in the antigen that are directly involved in binding to an antibody (also called the immunodominant component of the epitope) and other amino acid residues, which are not directly involved in the binding. In some embodiments, the term epitope herein includes both types of binding sites of any particular region of CLEC2D that specifically binds to an anti-CLEC2D antibody, or another CLEC2D-specific agent according to this disclosure, unless otherwise stated (e.g., in some contexts this disclosure relates to antibodies that bind directly to particular amino acid residues). More detailed epitope mapping of specific anti-CLEC2D antibody could be determined through an alanine scan approach.

In some embodiments, an anti-CLEC2D antibody or antibody fragment thereof, as disclosed herein, comprises a variable heavy chain sequence and a variable light chain sequence, that recognizes and binds to a human CLEC2D protein of amino acid sequence according to at least one of SEQ ID NOs: 886 to 920 and 930-1003.

In some embodiments, an anti-CLEC2D antibody or antibody fragment thereof, as disclosed herein, comprises a variable heavy chain sequence and a variable light chain sequence, that recognizes and binds to a human CLEC2D protein of amino acid sequence according to at least one of SEQ ID NOs: 886 to 909. In some embodiments, an anti-CLEC2D antibody or antibody fragment thereof, as disclosed herein, comprises a variable heavy chain sequence and a variable light chain sequence, that recognizes and binds to a human CLEC2D protein of amino acid sequence according to at least one of SEQ ID NOs: 930 to 1003.

In some embodiments, an anti-CLEC2D antibody or antibody fragment thereof, as disclosed herein, comprises a variable heavy chain sequence and a variable light chain sequence, that recognizes and binds to conformational epitope of CLEC2D antigen, comprises of amino acids positions either overlapping and/or non-overlapping with CD161 receptor interacting amino acid residues.

In some embodiments, an anti-CLEC2D antibody or antibody fragment thereof, as disclosed herein, comprises a variable heavy chain sequence and a variable light chain sequence, that inhibits or abrogates or competes with another antibody that recognizes and binds to conformational epitope of CLEC2D antigen, comprises of amino acids positions either overlapping and/or non-overlapping with CD161 receptor interacting amino acid residues.

In some embodiments, an antibody or antigen binding fragment thereof, as disclosed herein, comprises a variable heavy chain sequence and a variable light chain sequence that binds to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an antibody or antigen binding fragment thereof, as disclosed herein, comprises a variable heavy chain sequence and a variable light chain sequence that inhibits or abrogates or competes for, the binding of another antibody to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that when bound to CLEC2D selected from SEQ ID Nos: 886-920 and 930-1003 binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof In some embodiments, an antibody or antigen binding fragment thereof, as disclosed herein, comprises a variable heavy chain sequence and a variable light chain sequence that when bound to CLEC2D selected from SEQ ID Nos: 886-909 and 930-1003 binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an antibody or antigen binding fragment thereof, as disclosed herein, comprises a variable heavy chain sequence and a variable light chain sequence that when bound to CLEC2D selected from SEQ ID Nos: 886-890 binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumour killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an anti-CLEC2D antibody as disclosed herein, comprises a variable heavy chain sequence and a variable light chain sequence, that recognizes and binds to the amino acid residues: THR178; ASN95; ARG137; GLU179; TYR177; SER98; GLU162; GLN139; ARG101; ALA160; TRP96; CYS176; GLU138; ARG175; GLY140; SER136; ASP104; ASP92; THR97; LYS94; GLU150; THR149; GLY148; GLN141; PRO142; LYS144; THR152; TRP151; ASN147; ARG153; TRP143; ILE157; CYS163; SER129; THR93; LYS181; ASP91; ARG180; SER187; LYS194; TYR165; ALA174; LEU110; ASN167; ASP168; ILE146; SER172; GLY161; SER173; LEU135; ASP130; GLN100; PHE155; GLY159; PRO156; LEU158; GLN117; SER115; GLU114; GLN154; ASN120; PHE116; PHE102; GLN106; SER105; ASP107; LYS186; ASP109; GLN112; VAL191; TRP145; LYS169; GLY127; PRO128; GLN83; LYS85; GLU77; GLY170; LEU119; LEU123; TRP182; SER90; ALA108; TYR88; HIS190; ILE189; ALA73; ARG84; SER78; TRP79; PRO76; PHE82; ALA171; ASP188; CYS75 within a human CLEC2D of amino acid sequence according to SEQ ID NOs: 886, 889, 894, 899, 903, 905, 906 or 907.

In some embodiments, an anti-CLEC2D antibody as disclosed herein, comprises a variable heavy chain sequence and a variable light chain sequence, that recognizes and binds to the amino acid residues: ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, within a human CLEC2D of amino acid sequence according to SEQ ID NOs: 886, 889, 894, 899, 903, 905, 906 or 907.

In some embodiments, an anti-CLEC2D antibody or antibody fragment thereof, as disclosed herein, comprises a variable heavy chain sequence and a variable light chain sequence of SEQ ID 42 & SEQ ID 258, that recognizes and binds to a human CLEC2D protein of amino acid sequence according to at least one of SEQ ID NOs: 886 to 909. In some embodiments, an anti-CLEC2D antibody or antibody fragment thereof, as disclosed herein, comprises a variable heavy chain sequence and a variable light chain sequence of SEQ ID 42 & SEQ ID 258, that recognizes and binds to a human CLEC2D protein of amino acid sequence according to at least one of SEQ ID NOs: 921 to 909.

In some embodiments, an anti-CLEC2D antibody or antibody fragment thereof, as disclosed herein, comprises a variable heavy chain sequence and a variable light chain sequence, that recognizes and binds to conformational epitope of CLEC2D antigen, comprises of amino acids positions either overlapping and/or non-overlapping with CD161 receptor interacting amino acid residues.

In some embodiments, an anti-CLEC2D antibody or antibody fragment thereof, as disclosed herein, comprises a variable heavy chain sequence and a variable light chain sequence, that inhibits or abrogates or competes with another antibody that recognizes and binds to conformational epitope of CLEC2D antigen, and comprises of amino acids positions either overlapping and/or non-overlapping with CD161 receptor interacting amino acid residues.

In some embodiments, an antibody or antigen binding fragment thereof, as disclosed herein, comprises a variable heavy chain sequence and a variable light chain sequence that binds to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an antibody or antigen binding fragment thereof, as disclosed herein, comprises a variable heavy chain sequence and a variable light chain sequence that inhibits or abrogates or competes with, the binding of another antibody to conformational epitope of CLEC2D antigen comprising of any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting non-linear scaffolds for CD161 receptor interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-909 and 930-1003, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that binds to conformational epitope of CLEC2D antigen, comprises at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-890, constituting allosteric and non-linear scaffolds for CD161 receptor non-interacting amino acid residues, thereby blocking the interaction between CLEC2D and CD161 receptors.

In some embodiments, an antibody or antigen binding fragment thereof, as disclosed herein, comprises a variable heavy chain sequence and a variable light chain sequence that when bound to CLEC2D selected from SEQ ID Nos: 886-920 and 930-1003, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumor killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an antibody or antigen binding fragment thereof, as disclosed herein, comprises a variable heavy chain sequence and a variable light chain sequence that when bound to CLEC2D selected from SEQ ID Nos: 886-909 and 930-1003, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumor killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an antibody or antigen binding fragment thereof, as disclosed herein, comprises a variable heavy chain sequence and a variable light chain sequence that when bound to CLEC2D selected from SEQ ID Nos: 886-890, binds to at least one of the amino acids positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, either independently or in combination to induce tumor killing or cytotoxicity. In some embodiments, an antibody or antigen binding fragment thereof, as disclosed herein, induces cytotoxicity in at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%, of the total number of cells treated with the antibody or antigen binding fragment thereof.

In some embodiments, an anti-CLEC2D antibody, SEQ ID 42 & SEQ ID 258, as disclosed herein, comprises a variable heavy chain sequence and a variable light chain sequence, that recognizes and binds to the amino acid ARG175-XAA176-TYR177-XAA178-GLU179; ARG153; ARG84; HIS190.

In some embodiments, an anti-CLEC2D antibody, SEQ ID 44 & SEQ ID 260, as disclosed herein, comprises a variable heavy chain sequence and a variable light chain sequence, that recognizes and binds to the amino acid ARG101; GLU150-XAA151-THR152-ARG153-GLN154; ARG175-XAA176-TYR177-XAA178-GLU179.

In some embodiments, an anti-CLEC2D antibody, SEQ ID 45 & SEQ ID 261, as disclosed herein, comprises a variable heavy chain sequence and a variable light chain sequence, that recognizes and binds to the amino acid GLN141; ARG101-XAA102-XAA-103-XAA104-SER105-XAA106-ASP107; HIS190.

In some embodiments, an anti-CLEC2D antibody, SEQ ID 1 & SEQ ID 217, as disclosed herein, comprises a variable heavy chain sequence and a variable light chain sequence, that recognizes and binds to the amino acids GLN141; ARG153; ASP92-THR93-LYS94; HIS190.

In some embodiments, an anti-CLEC2D antibody SEQ ID 58 & SEQ ID 274, as disclosed herein, comprises a variable heavy chain sequence and a variable light chain sequence, that recognizes and binds to the amino acids GLU138-XAA139-XAA140-GLN141-XAA142-XAA143-LYS144; CYS176.

In some embodiments, an anti-CLEC2D antibody, SEQ ID 35 & SEQ ID 251, as disclosed herein, comprises a variable heavy chain sequence and a variable light chain sequence, that recognizes and binds to the amino acids GLU138-GLN139-XAA140-GLN141; ARG175-XAA176-TYR177-XAA178-XAA179-ARG180; SER187.

In some embodiments, an anti-CLEC2D antibody SEQ ID 21 & SEQ ID 237, as disclosed herein, comprises a variable heavy chain sequence and a variable light chain sequence that recognizes and binds to the amino acids ASP92; TYR177-XAA179-XAA180-LYS181; THR152-ARG153-GLN154.

In some embodiments, an anti-CLEC2D antibody, SEQ ID 7 & SEQ ID 223, as disclosed herein, comprises a variable heavy chain sequence and a variable light chain sequence, that recognizes and binds to the amino acids THR93-XAA94-ASN95; ARG101; GLN139; PHE116; ARG153.

In some embodiments, an anti-CLEC2D antibody, SEQ ID 73 & SEQ ID 289, as disclosed herein, comprises a variable heavy chain sequence and a variable light chain sequence, that recognizes and binds to the amino acids THR93-LYS94; ARG101; GLN141; TYR177-XAA178-GLU179.

In some embodiments, an anti-CLEC2D antibody, SEQ ID 73 & SEQ ID 289, as disclosed herein, comprises a variable heavy chain sequence and a variable light chain sequence, that recognizes and binds to any one of the amino acids according to SEQ ID NOs: 2561-2567.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2561.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2562.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2563.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2564.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2565.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2566.

In some embodiments, an anti-CLEC2D antibody, SEQ ID 73 & SEQ ID 289, as disclosed herein, comprises a variable heavy chain sequence and a variable light chain sequence, that recognizes and binds to the amino acids according to SEQ ID NO: 2567.

Library Screening

Without wishing to be bound by any particular technique, antibodies which bind to the antigens of the disclosure can be identified and characterized using the methods described below.

Provided herein is a naïve antibody library as a source of therapeutics for treatment of diseases comprising cancers, rheumatoid arthritis, neurological disorders, infectious diseases and metabolic disorders or any combination thereof. Antibodies identified using the methods of the disclosure can be used as diagnostic tools, as prognostic tools; for research purposes, for target discovery, for validation in functional genomics or any application where antibodies or derivatives of antibodies are employed.

In one embodiment, the term "panning" refers to an affinity selection technique which selects for binders against a specific target/antigen.

Figure 3:
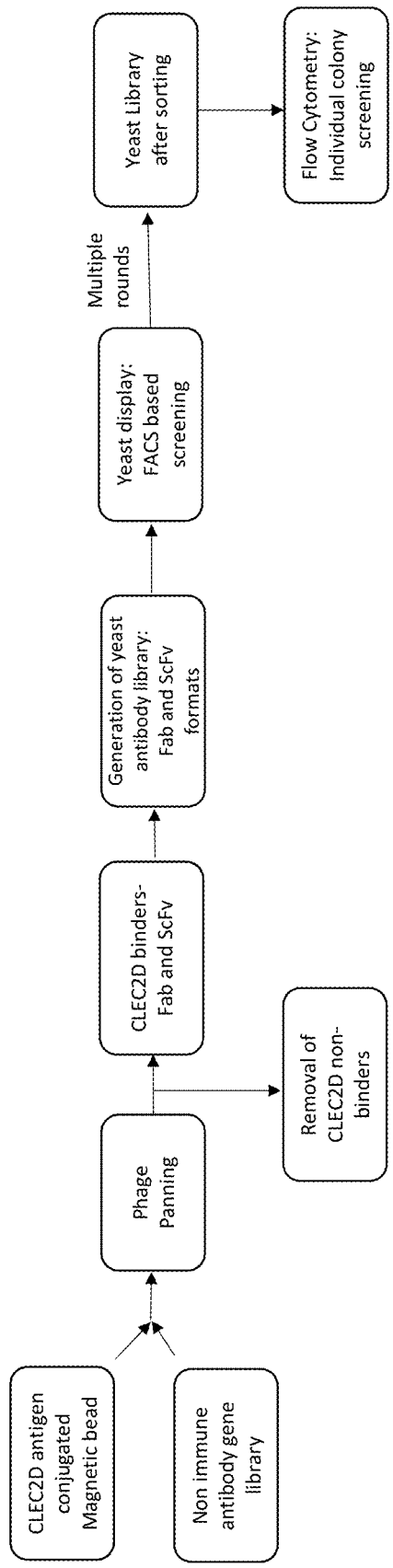
FIG. 3 illustrates a schematic depiction of an antibody library screening strategy: the naïve antibody library screened against the target CLEC2D antigen using phage and yeast surface display systems.

In some embodiments, methods of screening the naïve antibody gene expression library include sequentially exploring the expression profiles of a pool of gene clones by utilizing two separate scanning tools: 1) a phage display technology, and 2) a yeast display technology (FIG. 3). Use of yeast system for antibody gene expression is advantageous because of the eukaryotic protein translation, processing and proper folding of the antibody products on the cell surface. Further, yeast expression allows proper interaction with antigenic targets with high specificity.

In some embodiments, the methods disclosed herein preserve the diversity in the library that is capable of identifying unique molecules against varied antigenic targets.

In some embodiments of the methods of the disclosure, the methodology also involves a strategy wherein the diversity is translated between two platforms and explored as various engineered antibody formats including, but not limited to, chimeric antibody molecules, Fv, Fav, F(ab')2, Fab', dsFv, scFv, sc(Fv)2, scFv-CH3, scFv-Fc, ScFab, dimeric and trimeric antibody fragments, minibodies, humanized monoclonal antibody molecules, human antibodies, bispecific antibodies, fusion proteins comprising an Fc region of an antibody, and any functional fragments arising out of these molecules wherein the derivative molecules retain the immunological functionality of the parent antibody molecule, and all other antibody formats.

In some embodiments, the candidate antibody molecules obtained by the present method are further optimized through rational design guided by structure-function studies of antibody-antigen interactions. The prerequisite for success of manufacturability of monoclonal antibody drugs are dependent on a variety of biological and/or correlated properties such as solubility, aggregation, antigenicity, stability and so on. As exemplified, structure-based drug design, which is rational, evidence based and faster, has contributed tremendously to the field of cancer chemotherapy, drug resistant infections, neurological diseases, amongst others. The resulting outcome of these methods is employed in the instant disclosure to improve antibody library construction and manufacturability of selected molecules.

In some embodiments, the term "isolated" relates to novel and unique molecules comprising of two protein chains or fragments thereof which are not part of a biological membrane. In particular, the isolated molecule according to the current disclosure is soluble and is linked either directly or indirectly via linker molecules through covalent or non-covalent bonds. These molecules may comprise monoclonal or polyclonal antibodies, which can be easily obtained according to methods well-known to the man skilled in the art.

In some embodiments, an affinity tag may be included in an antigen or antibody disclosed herein for isolation or detection purposes. Affinity tags are well known in the art and are attached to a target and used to detect or isolate the target using a molecule that binds the affinity tag. In principal, any peptide or protein for which an antibody or other specific binding agent is available can be used as an affinity tag. Exemplary affinity tags suitable for use include, but are not limited to, a monocytic adaptor protein (MONA) binding peptide, a T7 binding peptide, a v5 tag, a streptavidin binding peptide, a polyhistidine tract, protein A (Nilsson et al., EMBO J. 4:1075 (1985); Nilsson et al., Methods Enzymol. 198:3 (1991)), glutathione S transferase (Smith and Johnson, Gene 67:31 (1988)), Glu-Glu affinity tag (Grussenmeyer et al., Proc. Natl. Acad. Sci. USA 82:7952 (1985)), substance P, FLAG peptide (Hopp et al., Biotechnology 6:1204 (1988)), or other antigenic epitope or binding domain. See, in general, Ford et al., Protein Expression and Purification 2:95 (1991). In one embodiment, a His6 tag is used in the methods disclosed herein. In another embodiment, a FLAG tag is used in the methods disclosed herein. In another embodiment, a v5 tag is used in the methods and compositions disclosed herein. DNA molecules encoding affinity tags are available from commercial suppliers (e.g., Pharmacia Biotech, Piscataway, N.J.).

Taken together, the methods of the present disclosure are centralized around identifying, validating, characterizing and developing novel monoclonal antibodies against CLEC2D antigenic target. These novel monoclonal antibodies are developed for use in therapeutics, diagnostics and prognostics products applicable in various diseases, including cancers.

In some embodiments, the antibody library, which can be a naïve antibody library, allows for isolation of unique antibody molecules with the desired functional properties for a specific therapeutic target. i.e., an antigen such as the CLEC2D protein or any fragments thereof disclosed herein.

The combination of a diverse library and an appropriate and compatible display platform enables the rapid selection and production of therapeutic antibodies with higher affinity and improved functionality against specific antigen molecule. Typical screening for targeted therapeutic antibody molecules comprises selecting molecules from a diverse and large antibody library against a target antigen through display platforms via smaller antibody fragments followed by constructing a full-length antibody molecule expressed in a mammalian cell line. Once expressed, the process of purification and several functional assays to validate the same are performed. Optimization of parameters such as identification of epitopes, formulation, stability studies and in vivo efficacy further strengthen the development of the selected lead antibodies.

In an exemplary embodiment of the present disclosure, the method of screening, isolation and development of monoclonal antibodies from the human naïve antibody library against CLEC2D antigen comprises the following description. Designing and generation of various CLEC2D antigen constructs, i.e., soluble ecto-domain of wild-type and mutants; full-length CLEC2D proteins, in appropriately optimized/customized vectors to express in mammalian system followed by purification through affinity chromatography methods to homogeneity.

In some embodiments, the screening of a library of molecules is performed by about 1 to 3 rounds of phage panning with a CLEC2D antigen. During each round, specific binders are selected out from the library by removing non-binders. Selected pools of molecules screened in the phage display platform are transferred, with or without randomization of selected diversity, to a yeast surface display platform. This avoids any PCR based method steps, thereby preserving the selected pool of molecules against the CLEC2D antigen. The yeast display platform comprises expressing a variety of antibody moieties in different formats. Displayed fragments are screened against specific antigenic targets and specific populations showing higher affinity to the target antigen are separated. These selected pools are further tested for antigen specificity. Finally, individual clones are separated and clonal populations are used for sequencing of individual antibody clones.

Methods of phage panning against antigens are known in the art. For example, magnetic beads can be used. Antigen coated on magnetic dynabeads can be prepared, and a phage antibody library panned against the antigen coated beads to separate phage particles expressing the desired antibody clones.

Purified DNA can then be digested and ligated into a suitable yeast expression vector to generate antibodies in the desired format, such as Fab or ScFv. Yeast cells can be transformed by standard methods and checked for antibody expression. The surface expression of antibodies can be analysed with multiple tags such as FLAG, c-Myc and $(His)_6$-tag and V5-tag for heavy chains and light chains, respectively and immunohistochemistry. Flow cytometry can be used to isolate yeast cells expressing antibody sequences showing specific antigen binding. Flow cytometry sorting of yeast cell populations can be repeated at least 1×, at least 2×, at least 3×, at least 4× or at least 5× to enrich for antibody clones with higher affinity towards labelled antigens.

Individual yeast clones are sequences using methods standard in the art, and the antibody sequences are further cloned into suitable mammalian gene expression vectors.

The disclosure provides methods of screening a high diversity antibody gene library for antibodies that bind to a CLEC2D antigen. In some embodiments, the methods comprise inserting a library of antibody genes into a phage protein gene in a vector, and transforming phages to produce a phage library comprising the high diversity antibody gene library. The phages in the phage library display the library of antibody genes on the surface of the phage. This phage library is then panned with a CLEC2D antigen for individual phages that bind to the CLEC2D antigen, thereby producing an enriched phage library that is enriched for antibody genes that encode antibodies that bind to the CLEC2D antigen. This panning can be accomplished, for example, by conjugating the antigen to magnetic beads, which can be used to isolated phages that bind to the antigen on the beads. The panning step can be repeated at least once, at least twice or more times to enrich for phages expressing antibodies or antibody fragments that bind to the antigen.

Antibody or antibody fragment genes from the enriched phage library are then transferred to a yeast surface display library. In some embodiments, this is accomplished by cloning the antibody or antibody fragment genes into a suitable yeast transformation vector, and transforming yeast cells with methods that are standard in the art. Yeast cells that express antibody or antibody fragments that bind that bind to the CLEC2D antigen are then isolated. In some embodiments, this isolation is accomplished using flow cytometry to sort the yeast cells. In some embodiments, the method further comprises repeating the flow cytometry isolation at least 1×, at least 2×, at least 3×, at least 4× or at least 5× or more times to enrich for yeast cells expressing antibodies or antibody fragments that bind the antigen. In some embodiments, the methods further comprise analyzing the surface expression of the antibody genes with a FLAG tag, a c-Myc tag, a polyhistidine tag or a V5 tag. In some embodiments, the method further comprises cloning the antibody genes that bind to CLEC2D into a mammalian expression vector.

Optimization and Purification

In some embodiments, the methods disclosed herein comprise the design, generation and optimization of vector constructs for smooth transfer of selected antibody gene sequences to mammalian cell lines such as Chinese hamster ovary (CHO) cell lines for expression, stable cell-line generation and subsequent purification of full-length monoclonal antibody. This allows the rapid and efficient establishment of stable cell lines expressing monoclonal antibodies with excellent homogeneity in terms of conformation and posttranslational modification that are seen in downstream processes.

All cell lines suitable for the expression and purification of antibodies or antibody fragments are considered to be within the scope of the disclosure. In some embodiments, the cell line is a mammalian cell line. Cell lines can be isolated or derived from any source, including human, mouse and hamster. Suitable cell lines include, but are not limited to, Chinese Hamster Ovary (CHO) cells, HEK 293 cells, HEK293T cells, BHK21 cells, NSO cells, PER.C6 cells, B cells, HEK 293-6E cells, Sp2/0-Ag14 cells and DG44 cells.

In some embodiments, the CDR lengths and the amino acid composition of antibody clones is analyzed to understand the novelty of these clones. Additional careful analysis is performed to eliminate clones that have motifs with detrimental to physico-chemical properties that have a direct impact on purification strategy, stability, and charge variants present or within the antibodies.

In some embodiments, the scale up of lead antibody clones is achieved through defined culture media, supplements, and specific bioreactor processes which are known in the art and described herein.

Exemplary purification methods of the disclosure comprise multiple steps of chromatography techniques that utilize the exploiting physico-chemical nature of the amino acid composition in antibody molecules. In addition, higher purity can be attained by effectively removing the host cell protein/impurities, polymer (or aggregate), of the antibody and improving the antibody recovery rate. Purification of antibody molecules is concluded with appropriate formulation which will further improve the stability.

Therapeutic compositions comprise of conditions that are sterile and stable under the conditions of manufacture and storage.

Antibody purification processes will be known to those of skill in the art. Without wishing to be bound by any particular process, exemplary antibody purification processes comprise centrifugation of a primary cell culture expressing the antibody or antibody fragment to be purified, followed by further clarification using a filter such as a 3 µm-30 µm filter. Subsequently, collected filtrate can be further filtered, for example through 0.22 µm filters. This sample can be loaded onto a column for further purification by liquid chromatography. Exemplary columns include, but are not limited to, XK 16/20 Protein A Columns. Liquid chromatography can include treatment with a high salt wash buffer to remove loosely bound host cell proteins and other impurities. A low pH wash buffer can remove traces of impurities. Subsequently, bound protein can be eluted using 30 mM Phosphate buffer at pH.3.0-4.0. This sample can be diluted to reduce the conductivity, and then can be further purified using anion exchange (AEX) Chromatography in a flow through mode (i.e., using negative binding). An exemplary AEX column includes, but is not limited to, a Q Sepharose XK 16/20 column, which can be pre-equilibrated in 10-100 mM Histidine and/or citrate and/or phosphate and/or MES and/or acetate buffer (pH 4.5-6.5). Weakly interacting proteins can be removed using an elution buffer as a wash, and bound proteins such as the antibodies or antibody fragments of the disclosure are eluted, for example, in a single step using elution buffer containing 1 M NaCl and/or KCl. Flow through from AEX Chromatography can be loaded onto a pre-equilibrated apto SP ImpRes C10/20 column in 10-100 mM Histidine and/or citrate and/or phosphate and/or 2-(N-morpholino)ethanesulfonic acid (MES) and/or Acetate buffer (pH 4.5-6.5). Bound proteins such as antibodies or antibody fragments of the disclosure can be eluted through step elution followed by gradient elution using elution buffer (Equilibration buffer containing 200-1000 mM NaCl and/or KCl, pH 4.5-6.5). However, high salt buffer containing 1 to 1.5 M NaCl, pH 4.5-6.5, can be to remove strongly bound proteins, if present.

Taken together, antibodies and antibody fragments of the disclosure can be purified through multiple steps of chromatography techniques in order to achieve high purity, while effectively removing the host cell protein/impurities, polymer (or aggregate), of the antibody and improving the antibody recovery rate; Exemplary chromatography methods include the use of a mixed mode resin having both an ion exchange group and a hydrophobic functional group. Amino acids can be used as an additive.

Methods of Treatment

As used herein. "treating" or "treat" describes the management and care of a patient for the purpose of combating a disease, condition, or disorder and includes the administration of an antibody or pharmaceutical composition comprising same of the disclosure to alleviate one or more symptoms or complications of a disease, condition or disorder, or to eliminate the disease, condition or disorder. The term "treat" can also include treatment of a cell in vitro or an animal model.

An antibody of the present disclosure, or a pharmaceutical composition thereof, can also be used to prevent a disease, condition or disorder, or used to identify suitable candidates for such purposes. As used herein, "preventing" or "prevent" describes reducing or eliminating the onset of the symptoms or complications of the disease, condition or disorder.

As used herein, the term "alleviate" is meant to describe a process by which the severity of a sign or symptom of a disorder is decreased. Importantly, a sign or symptom can be alleviated without being eliminated. In a preferred embodiment, the administration of pharmaceutical compositions of this disclosure leads to the elimination of a sign or symptom, however, elimination is not required. Effective dosages are expected to decrease the severity of a sign or symptom. For instance, a sign or symptom of a disorder such as cancer, which can occur in multiple locations, is alleviated if the severity of the cancer is decreased within at least one of multiple locations.

As used herein the term "symptom" is defined as an indication of disease, illness, injury, or that something is not right in the body. Symptoms are felt or noticed by the individual experiencing the symptom, but may not easily be noticed by others. Others are defined as non-health-care professionals.

As used herein the term "sign" is also defined as an indication that something is not right in the body. But signs are defined as things that can be seen by a doctor, nurse, or other health care professional.

A therapeutically effective amount of an antibody of the disclosure relates generally to the amount needed to achieve a therapeutic objective. As noted above, this may be a binding interaction between the antibody and its target antigen that, in certain cases, interferes with the functioning of the target. The amount required to be administered will furthermore depend on the binding affinity of the antibody for its specific antigen, and will also depend on the rate at which an administered antibody is depleted from the free volume other subject to which it is administered. Common ranges for therapeutically effective dosing of an antibody or antibody fragment of the disclosure may be, by way of nonlimiting example, from about 0.1 mg/kg body weight to about 50 mg/kg body weight. Common dosing frequencies may range, for example, from twice daily to once a week.

Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. (See, e.g., Marasco et al., Proc. Natl. Acad. Sci. USA, 90: 7889-7893 (1993)).

In a non-limiting embodiment of the disclosure, isolated monoclonal antibodies reveal differential expression of CLEC2D on various cell surfaces, including immune cells and tumor cells, in response to various inducing conditions. This indicates the use of anti-CLEC2D antibodies as therapeutic agents for multiple disease indications.

The disclosure provides methods of treating diseases by modulating or inhibiting the interaction of CLEC2D with its cognate receptor CD161 by administering the compositions, the antibodies or antigen binding fragments thereof, and/or nucleic acids encoding the antibodies or antigen binding fragments thereof of the disclosure to a subject in need thereof.

In some embodiments, the diseases treated by the compositions, antibodies or antigen binding fragments thereof, and/or nucleic acids encoding the antibodies or antigen binding fragments thereof of the disclosure is a cancer, an autoimmune disease, an inflammatory disease, an infectious disease, or other diseases in which CLEC2D plays a role (e.g., by inhibiting CD161) in the initiation and/or development of the disease.

Exemplary diseases include, but are not limited to seronegative spondyloarthropathies such as psoriatic arthritis, ankylosing spondylitis, reiters syndrome and spondyloarthropathy associated with inflammatory bowel disease.

Exemplary diseases include, but are not limited to prosthetic joint loosening.

Exemplary diseases include, but are not limited to connective tissue diseases such as juvenile rheumatoid arthritis, rheumatoid arthritis, systemic lupus erythematosus (SLE) and lupus nephritis, scleroderma, Sjogren's syndrome, mixed connective tissue disease and polymyositis, dermatomyositis.

Exemplary diseases include, but are not limited to inflammatory bowel diseases such as Crohn's disease and ulcerative colitis.

Exemplary diseases include, but are not limited to Whipples disease and arthritis associated with granulomatous ileocolitis.

Exemplary diseases include, but are not limited to inflammatory skin conditions such as autoimmune bullous pemphigoid, autoimmune pemphigus vulgaris, eczema and dermatitis.

Exemplary diseases include, but are not limited to inflammatory lung diseases such as alveolitis, pulmonary fibrosis, sarcoidoisis, asthma, bronchitis and bronchiolitis obliterans.

Exemplary diseases include, but are not limited to inflammatory renal diseases such as glomerulonethritis, renal allograft rejection and renal tubular inflammation.

Exemplary diseases include, but are not limited to atherosclerosis.

Exemplary diseases include, but are not limited to systemic vasculitis such as temporal arteritis/giant cell arteritis, takayasu arteritis, polyarteritis nodosa, Kawasaki disease, Wegener's granulomatosis, churg strauss syndrome, microscopic polyangiitis, necrotising glomerulonephritis, henoch schonlein purpura, essential cryoglobulinaemic vasculitis, other small vessel vasculitis and Behcets disease Exemplary diseases include, but are not limited to macrophage activation diseases such as macrophage activation syndrome (MAS), adult onset stills disease and haemophagocytic syndrome.

Exemplary diseases include, but are not limited to polymyalgia rheumatica, primary biliary sclerosis, sclerosing cholangitis, autoimmune hepatitis, Type 1 Diabetes Mellitus, Hashimoto's thyroiditis, Graves' disease, multiple sclerosis (MS), Guillain-Barre syndrome, Addison's disease, and/or Raynaud's phenomenon and Goodpasture's syndrome.

Exemplary diseases include, but are not limited to diseases linked with cancers and cancers, which comprise breast cancer, prostate cancer, endometrial cancer, uterine cancer, bladder cancer, kidney cancer, esophageal cancer, squamous cell carcinoma, uveal melanoma, glioma, glioblastoma, myeloma, pheochromocytoma, paraganglioma, follicular lymphoma, renal cell carcinoma, cendcal cancer, ovarian cancer, cervical cancer, lung cancer, colorectal cancer, brain cancer, pancreatic cancer, gastric cancer, intestinal cancer, testicular cancer, skin cancer, thyroid cancer, thymoma, head and neck cancer, liver cancer, pharynx cancer, adrenocortical cancer, cholangiocarcinoma, mesothelioma, sarcoma, leukemia, lymphoma, Hodgkin's disease, multiple myeloma, melanoma, astrocytoma, stomach cancer, pulmonary adenocarcinoma, adenocarcinoma, acinic cell adenocarcinoma, adrenal cortical carcinomas, alveoli cell carcinoma, anaplastic carcinoma, basaloid carcinoma, basal cell carcinoma, bronchiolar carcinoma, bronchogenic carcinoma, renaladinol carcinoma, embryonal carcinoma, anometroid carcinoma, fibrolamolar liver cell carcinoma, follicular carcinomas, giant cell carcinomas, hepatocellular carcinoma, intraepidermal carcinoma, intraepithelial carcinoma, leptomanigio carcinoma, medullary carcinoma, melanotic carcinoma, menigual carcinoma, mesometonephric carcinoma, oat cell carcinoma, squamal cell carcinoma, sweat gland carcinoma, transitional cell carcinoma, tubular cell carcinoma, ameloblastic sarcoma, angiolithic sarcoma, botryoid sarcoma, endometrial stroma sarcoma, ewing sarcoma, fascicular sarcoma, giant cell sarcoma, granulositic sarcoma, immunoblastic sarcoma, juxacordial osteogenic sarcoma, coppices sarcoma, leukocytic sarcoma (leukemia), lymphatic sarcoma (lympho sarcoma), medullary sarcoma, myeloid sarcoma (granulocitic sarcoma), austiogenci sarcoma, periosteal sarcoma, reticulum cell sarcoma (histiocytic lymphoma), round cell sarcoma, spindle cell sarcoma, synovial sarcoma, telangiectatic audiogenic sarcoma, Burkitt's lymphoma, NPDL, NML, NH, diffuse lymphomas, Hodgkin's lymphoma, non-Hodgkin's lymphoma, B-cell lymphoma, T-cell lymphoma, diffuse large B-cell lymphoma, acute myeloid lymphoma, chronic lymphocytic leukemia, chronic myeoloid leukemia, mantle cell lymphoma, and follicular lymphoma.

Exemplary diseases include, but are not limited to Adrenocortical Carcinoma, Bladder Urothelial Carcinoma, Breast Invasive Carcinoma, Cervical Squamous Cell Carcinoma and Endocervical Adenocarcinoma, Cholangiocarcinoma, Colon Adenocarcinoma, Lymphoid Neoplasm Diffuse Large B-cell Lymphoma, Esophageal Carcinoma, Glioblastoma Multiforme, Head and Neck Squamous Cell Carcinoma, Kidney Chromophobe, Kidney Renal Clear Cell Carcinoma, Kidney Renal Papillary Cell Carcinoma, Acute Myeloid Leukemia, Brain Lower Grade Glioma, Liver Hepatocellular Carcinoma, Lung Adenocarcinoma, Lung Squamous Cell Carcinoma, Mesothelioma, Ovarian Serous Cystadenocarcinoma, Pancreatic Adenocarcinoma, Pheochromocytoma and Paraganglioma, Prostate Adenocarcinoma, Rectum Adenocarcinoma, Sarcoma, Skin Cutaneous Melanoma, Stomach Adenocarcinoma, Testicular Germ Cell Tumors, Thyroid Carcinoma, Thymoma, Uterine Corpus Endometrial Carcinoma, Uterine Carcinosarcoma, and Uveal Melanoma.

According to a preferred embodiment, the compositions and methods of this disclosure are directed to the treatment of metastatic cancer to bone, wherein the metastatic cancer is breast, lung, renal, multiple myeloma, thyroid, prostate, adenocarcinoma, blood cell malignancies, including leukemia and lymphoma; head and neck cancers; gastrointestinal cancers, including esophageal cancer, stomach cancer, colon cancer, intestinal cancer, colorectal cancer, rectal cancer, pancreatic cancer, liver cancer, pharynx cancer, cancer of the bile duct or gall bladder; malignancies of the female genital tract, including ovarian carcinoma, uterine endometrial cancers, vaginal cancer, and cervical cancer; bladder cancer; brain cancer, including neuroblastoma; sarcoma, osteosarcoma; and skin cancer, including malignant melanoma or squamous cell cancer.

In some embodiments, the methods of treatment of a disease or disorder in a subject, as disclosed herein, relates to activation of an immune cell in the subject in need thereof. In some embodiments, the methods of treatment of a disease or disorder in a subject, as disclosed herein, relates to activation of an immune cell (e.g., NK cell, B-cell, or T-cell). In some embodiments, the methods of treatment of a disease or disorder in a subject, as disclosed herein, relates to treatment of a mammalian subject. In some embodiments, the methods of treatment of a disease or disorder in a subject, as disclosed herein, relates to treatment of a human subject.

In some embodiments, the anti-CLEC2D antibodies or a composition comprising the anti-CLEC2D antibodies of the disclosure, are used as a therapeutic agents for treatment of a disease or disorder, in a subject in need thereof.

In some embodiments, the anti-CLEC2D antibodies or a composition comprising the anti-CLEC2D antibodies of the disclosure, are used as a therapeutic agents for treatment of a disease or disorder associated with differential or aberrant expression of CLEC2D on various cell surfaces, in a subject in need thereof.

In some embodiments, the anti-CLEC2D antibodies or a composition comprising the anti-CLEC2D antibodies of the disclosure, are used as a therapeutic agents for treatment of a disease or disorder associated with differential or aberrant expression of CLEC2D on various cell surfaces, in a subject in need thereof, wherein the cells are immune cells or tumor cells.

In some embodiments, the anti-CLEC2D antibodies or a composition comprising the anti-CLEC2D antibodies of the disclosure, are used as a therapeutic agents for treatment of a disease or disorder associated with differential or aberrant expression of CLEC2D in various cell surfaces, in a subject in need thereof wherein the anti-CLEC2D antibodies or a composition comprising the anti-CLEC2D antibodies are administered to the subject in an amount effective for modulating or inhibiting the interaction of CLEC2D with its cognate receptor CD161.

In some embodiments, the anti-CLEC2D antibodies or a composition comprising the anti-CLEC2D antibodies of the disclosure, are used as a therapeutic agents for treatment of a disease or disorder associated with differential or aberrant expression of CLEC2D in various cell surfaces, in a subject in need thereof, wherein the anti-CLEC2D antibodies or a composition comprising the anti-CLEC2D antibodies are administered to the subject in an amount effective for binding to and activating NK cells.

In some embodiments, the anti-CLEC2D antibodies or a composition comprising the anti-CLEC2D antibodies of the disclosure, are used as a therapeutic agents for treatment of a disease or disorder associated with differential or aberrant expression of CLEC2D, in a subject in need thereof, wherein the method comprises administering the anti-CLEC2D antibodies or a composition comprising the anti-CLEC2D antibodies in an amount effective for treatment or alleviating the symptoms of the disease in the subject. In some embodiments, the anti-CLEC2D antibodies or a composition comprising the anti-CLEC2D antibodies of the disclosure, used in a method of treating a disease or disorder associated with differential or aberrant expression of CLEC2D, in a subject in need thereof, modulate or inhibit the interaction of CLEC2D with its cognate receptor CD161.

In some embodiments, the anti-CLEC2D antibodies or a composition comprising the anti-CLEC2D antibodies of the disclosure, are used in a method of treating a disease or disorder including; but not limited to seronegative spondyloarthropathies such as psoriatic arthritis, ankylosing spondylitis, reiters syndrome and spondyloarthropathy associated with inflammatory bowel disease, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to connective tissue diseases such as juvenile rheumatoid arthritis, rheumatoid arthritis, systemic lupus erythematosus (SLE) and lupus nephritis, scleroderma, Sjogren's syndrome, mixed connective tissue disease and polymyositis, dermatomyositis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to connective tissue diseases such as juvenile rheumatoid arthritis, rheumatoid arthritis, systemic lupus erythematosus (SLE) and lupus nephritis, scleroderma, Sjogren's syndrome, mixed connective tissue disease and polymyositis, dermatomyositis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including; but not limited to connective tissue diseases such as juvenile rheumatoid arthritis, rheumatoid arthritis, systemic lupus erythematosus (SLE) and lupus nephritis, scleroderma, Sjogren's syndrome, mixed connective tissue disease and polymyositis, dermatomyositis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including; but not limited to connective tissue diseases such as inflammatory bowel diseases such as Crohn's disease and ulcerative colitis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC22) antibodies or a composition comprising the anti-CLEC2D antibodies of the disclosure, are used in a method of treating a disease or disorder including but not limited to connective tissue diseases such as Whipples disease and arthritis associated with granulomatous ileocolitis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to inflammatory skin conditions such as autoimmune bullous pemphigoid, autoimmune pemphigus vulgaris, eczema and dermatitis, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to inflammatory lung diseases such as alveolitis, pulmonary fibrosis, sarcoidoisis, asthma, bronchitis and bronchiolitis obliterans, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to atherosclerosis and coronary vascular diseases in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to inflammatory renal diseases such as glomerulonethritis, renal allograft rejection and renal tubular inflammation, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to systemic vasculitis such as temporal arteritis/giant cell arteritis, takayasu arteritis, polyarteritis nodosa, Kawasaki disease, Wegener's granulomatosis, churg strauss syndrome, microscopic polyangiitis, necrotising glomerulonephritis, henoch schonlein purpura, essential cryoglobulinaemic vasculitis, other small vessel vasculitis and Behcets disease, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to systemic vasculitis such as temporal arteritis/giant cell arteritis, takayasu arteritis, polyarteritis nodosa, Kawasaki disease, Wegener's granulomatosis, churg strauss syndrome, microscopic polyangiitis, necrotising glomerulonephritis, henoch schonlein purpura, essential cryoglobulinaemic vasculitis, other small vessel vasculitis and Behcets disease, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to macrophage activation diseases such as macrophage activation syndrome (MAS), adult onset stills disease and haemophagocytic syndrome, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to polymyalgia rheumatica, primary biliary sclerosis, sclerosing cholangitis, autoimmune hepatitis, Type 1 Diabetes Mellitus, Hashimoto's thyroiditis, Graves' disease, multiple sclerosis (MS), Guillain-Barre syndrome, Addison's disease, and/or Raynaud's phenomenon and Goodpasture's syndrome, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with cancer and cancers, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with cancer and cancers, which comprise breast cancer, prostate cancer, endometrial cancer, uterine cancer, bladder cancer, kidney cancer, esophageal cancer, squamous cell carcinoma, uveal melanoma, glioma, glioblastoma, myeloma, pheochromocytoma, paraganglioma, follicular lymphoma, renal cell carcinoma, cendcal cancer, ovarian cancer, cervical cancer, lung cancer, colorectal cancer, brain cancer, pancreatic cancer, gastric cancer, intestinal cancer, testicular cancer, skin cancer, thyroid cancer, thymoma, head and neck cancer, liver cancer, pharynx cancer, adrenocortical cancer, cholangiocarcinoma, mesothelioma, sarcoma, leukemia, lymphoma, Hodgkin's disease, multiple myeloma, melanoma, astrocytoma, stomach cancer, pulmonary adenocarcinoma, adenocarcinoma, acinic cell adenocarcinoma, adrenal cortical carcinomas, alveoli cell carcinoma, anaplastic carcinoma, basaloid carcinoma, basal cell carcinoma, bronchiolar carcinoma, bronchogenic carcinoma, renaladinol carcinoma, embryonal carcinoma, anometroid carcinoma, fibrolamolar liver cell carcinoma, follicular carcinomas, giant cell carcinomas, hepatocellular carcinoma, intraepidermal carcinoma, intraepithelial carcinoma, leptomanigio carcinoma, medullary carcinoma, melanotic carcinoma, menigual carcinoma, mesometonephric carcinoma, oat cell carcinoma, squamal cell carcinoma, sweat gland carcinoma, transitional cell carcinoma, tubular cell carcinoma, ameloblastic sarcoma, angiolithic sarcoma, botryoid sarcoma, endometrial stroma sarcoma, ewing sarcoma, fascicular sarcoma, giant cell sarcoma, granulositic sarcoma, immunoblastic sarcoma, juxaccordial osteogenic sarcoma, coppices sarcoma, leukocytic sarcoma (leukemia), lymphatic sarcoma (lympho sarcoma), medullary sarcoma, myeloid sarcoma (granulocitic sarcoma), austiogenci sarcoma, periosteal sarcoma, reticulum cell sarcoma (histiocytic lymphoma), round cell sarcoma, spindle cell sarcoma, synovial sarcoma, telangiectatic audiogenic sarcoma, Burkitt's lymphoma, NPDL, NML, NH, diffuse lymphomas, Hodgkin's lymphoma, non-Hodgkin's lymphoma, B-cell lymphoma, T-cell lymphoma, diffuse large B-cell lymphoma, acute myeloid lymphoma, chronic lymphocytic leukemia, chronic myeloid leukemia, mantle cell lymphoma, and follicular lymphoma, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with a metastatic cancer or cancers, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with a metastatic cancer or cancers, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with a metastatic cancer or cancers to bone, in a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibodies or a composition comprising the anti-CLEC2D antibodies of the disclosure, are used in a method of treating a disease or disorder including but not limited to diseases linked with a metastatic cancer or cancers, wherein the metastatic cancer is breast, lung, renal, multiple myeloma, thyroid, prostate, adenocarcinoma, blood cell malignancies, including leukemia and lymphoma; head and neck cancers; gastrointestinal cancers, including esophageal cancer, stomach cancer, colon cancer, intestinal cancer, colorectal cancer, rectal cancer, pancreatic cancer, liver cancer, cancer of the bile duct or gall bladder; malignancies of the female genital tract, including ovarian carcinoma, uterine endometrial cancers, vaginal cancer, and cervical cancer; bladder cancer; brain cancer, including neuroblastoma; sarcoma, osteosarcoma; and skin cancer, including malignant melanoma or squamous cell cancerin a subject in need thereof, wherein the method comprises administering the anti-CLEC2D antibodies or a composition comprising the anti-CLEC2D antibodies in an amount effective for treatment or alleviating the symptoms of the disease in the subject.

In some embodiments, the anti-CLEC2D antibody and compositions of the disclosure, are used in a method of treatment of a subject by organ transplant or adoptive immune cell transplant. In some embodiments, the anti-CLEC2D antibody and compositions of the disclosure, block CD161 and CLEC2D interaction and reduces Graft vs Host rejection, due to killing if recipient dendritic cells by alloreactive NK cells.

In some embodiments, the anti-CLEC2D antibody and compositions of the disclosure, are used in a method of treatment of an infectious disease in a subject caused by microorganisms including but not limited to bacteria, fungi, protozoa, parasites, and viruses. In some embodiments, the anti-CLEC2D antibody and compositions of the disclosure, is used in a method of treatment of a bacterial disease in a subject caused by any one or more of (or any combination of) *Acinetobacter baumanii, Actinobacillus* sp., Actinomycetes, *Actinomyces* sp. (such as *Actinomyces israelii* and *Actinomyces naeslundii*), *Aeromonas* sp. (such as *Aeromonas hydrophila, Aeromonas veronii biovar sobria* (*Aeromonas sobria*), and *Aeromonas caviae*), *Anaplasma phagocytophilum, Anaplasma* marginale *Alcaligenes xylosoxidans, Acinetobacter baumanii, Actinobacillus actinomycetemcomitans, Bacillus* sp. (such as *Bacillus anthracis, Bacillus cereus, Bacillus subtilis, Bacillus thuringiensis*, and *Bacillus stearothermophilus*), *Bacteroides* sp. (such as *Bacteroides fragilis*), *Bartonella* sp. (such as *Bartonella bacilliformis* and *Bartonella henselae, Bifidobacterium* sp., *Bordetella* sp. (such as *Bordetella pertussis, Bordetella parapertussis*, and *Bordetella bronchiseptica*), *Borrelia* sp. (such as *Borrelia recurrentis*,and *Borrelia burgdorferi*), *Brucella* sp. (such as *Brucella abortus, Brucella canis, Brucella melintensis* and *Brucella suis*), *Burkholderia* sp. (such as *Burkholderia pseudomallei* and *Burkholderia cepacia*), *Campylobacter* sp. (such as *Campylobacter jejuni, Campylobacter coli, Campylobacter lari* and *Campylobacter fetus*), *Capnocytophaga* sp., *Cardiobacterium hominis, Chlamydia trachomatis, Chlamydophila pneumoniae, Chlamydophila psittaci, Citrobacter* sp. *Coxiella burnetii, Corynebacterium* sp. (such as, *Corynebacterium diphtheriae, Corynebacterium jeikeum* and *Corynebacterium*), *Clostridium* sp. (such as *Clostridium perfringens, Clostridium difficile, Clostridium botulinum* and *Clostridium tetani*), *Eikenella corrodens, Enterobacter* sp. (such as *Enterobacter aerogenes, Enterobacter agglomerans, Enterobacter cloacae* and *Escherichia coli*, including opportunistic *Escherichia coli*, such as enterotoxigenic *E. coli*, enteroinvasive *E. coli*, enteropathogenic *E. coli*, enterohemorrhagic *E. coli*, enteroaggregative *E. coli* and uropathogenic *E. coli*) *Enterococcus* sp. (such as *Enterococcus faecalis* and *Enterococcus faecium*), *Ehrlichia* sp. (such as *Ehrlichia* chafeensia and *Ehrlichia canis*), *Epidermophyton floccosum, Erysipelothrix rhusiopathiae, Eubacterium* sp., *Francisella tularensis, Fusobacterium nucleatum, Gardnerella vaginalis, Gemella morbillorum, Haemophilus* sp. (such as *Haemophilus influenzae, Haemophilus ducreyi, Haemophilus aegyptius, Haemophilus parainfluenzae, Haemophilus haemolyticus* and *Haemophilus parahaemolyticus, Helicobacter* sp. (such as *Helicobacter pylori, Helicobacter cinaedi* and *Helicobacter fennelliae*), *Kingella kingii, Klebsiella* sp. (such as *Klebsiella pneumoniae, Klebsiella granulomatis* and *Klebsiella oxytoca*), *Lactobacillus* sp., *Listeria monocytogenes, Leptospira interrogans, Legionella pneumophila, Leptospira interrogans, Peptostreptococcus* sp., *Mannheimia hemolytica, Microsporum canis, Moraxella catarrhalis, Morganella* sp., *Mobiluncus* sp., *Micrococcus* sp., *Mycobacterium* sp. (such as *Mycobacterium leprae, Mycobacterium tuberculosis, Mycobacterium paratuberculosis, Mycobacterium intracellulare, Mycobacterium avium, Mycobacterium bovis*, and *Mycobacterium marinum*), *Mycoplasm* sp. (such as *Mycoplasma pneumoniae, Mycoplasma hominis*, and *Mycoplasma genitalium*), *Nocardia* sp. (such as *Nocardia aster-*

*oides, Nocardia cyriacigeorgica* and *Nocardia brasiliensis*), *Neisseria* sp. (such as *Neisseria gonorrhoeae* and *Neisseria meningitidis*), *Pasteurella multocida, Pityrosporum orbiculare* (*Malassezia furfur*), *Plesiomonas shigelloides*. *Prevotella* sp., *Porphyromonas* sp., *Prevotella melaninogenica, Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionib acterium acnes, Rhodococcus equi, Rickettsia* sp. (such as *Rickettsia rickettsii, Rickettsia akari* and *Rickettsia prowazekii, Orientia tsutsugamushi* (formerly: *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella cholerasuis* and *Salmonella typhimurium*), *Serratia* sp. (such as *Serratia marcesans* and *Serratia liquifaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus hemolyticus, Staphylococcus saprophyticus*), *Streptococcus* sp. (such as *Streptococcus pneumoniae* (for example chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, erythromycin-resistant serotype 14 *Streptococcus pneumoniae*, optochin-resistant serotype 14 *Streptococcus pneumoniae*, rifampicin-resistant serotype 18C *Streptococcus pneumoniae*, tetracycline-resistant serotype 19F *Streptococcus pneumoniae*, penicillin-resistant serotype 19F *Streptococcus pneumoniae*, and trimethoprim-resistant serotype 23F *Streptococcus pneumoniae*, chloramphenicol-resistant serotype 4 *Streptococcus pneumoniae*, spectinomycin-resistant serotype 6B *Streptococcus pneumoniae*, streptomycin-resistant serotype, 9V *Streptococcus pneumoniae*, optochin-resistant serotype 14 *Streptococcus pneumoniae*, rifampicin-resistant serotype 18C *Streptococcus pneumoniae*, penicillin-resistant serotype 19F, *Streptococcus pneumoniae*, or trimethoprim-resistant serotype 23F *Streptococcus pneumoniae*), *Streptococcus agalactiae, Streptococcus mutans, Streptococcus pyogenes*, Group A streptococci, *Streptococcus pyogenes*, Group B streptococci, *Streptococcus agalactiae*, Group C streptococci, *Streptococcus anginosus, Streptococcus* equismilis, Group D streptococci, *Streptococcus bovis*, Group F streptococci, and *Streptococcus anginosus* Group G streptococci), *Spirillum minus, Streptobacillus moniliformi, Treponema* sp. (such as *Treponema carateum, Treponema petenue, Treponema pallidum* and *Treponema endemicum, Trichophyton rubrum, T. mentagrophytes, Tropheryma whippelii, Ureaplasma urealyticum, Veillonella* sp., *Vibrio* sp. (such as *Vibrio cholerae, Vibrio parahemolyticus, Vibrio vulnificus, Vibrio parahaemolyticus, Vibrio vulnificus, Vibrio alginolyticus, Vibrio mimicus, Vibrio hollisae, Vibrio fluvialis, Vibrio metchnikovii, Vibrio damsela* and *Vibrio furnisii*), *Yersinia* sp. (such as *Yersinia enterocolitica, Yersinia pestis*, and *Yersinia pseudotuberculosis*) and *Xanthomonas maltophilia* among others.

In some embodiments, the anti-CLEC2D antibody and compositions of the disclosure, is used in a method of treatment of a fungal disease in a subject caused by any one or more of (or any combination of) *Aspergillus, Blastomyces, Candidiasis, Coccidiodomycosis, Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix*, fungal eye infections ringworm, *Exserohilum, Cladosporium.*

In some embodiments, the anti-CLEC2D antibody and compositions of the disclosure, is used in a method of treatment of a protozoan disease in a subject caused by any one or more of (or any combination of) Euglenozoa, Heterolobosea, Diplomonadida, Amoebozoa, Blastocystic, and Apicomplexa. Example Euglenoza include, but are not limited to, *Trypanosoma cruzi* (Chagas disease), *T. brucei* gambiense, *T. brucei* rhodesiense, *Leishmania braziliensis, L. infantum, L. mexicana, L. major, L. tropica*, and *L. donovani*. Example Heterolobosea include, but are not limited to, *Naegleria fowleri*. Example Diplomonadids include, but are not limited to, *Giardia intestinalis* (*G. lamblia, G. duodenalis*). Example Amoebozoa include, but are not limited to, *Acanthamoeba castellanii, Balamuthia madrillaris, Entamoeba histolytica*. Example Blastocysts include, but are not limited to, *Blastocystic hominis*. Example Apicomplexa include, but are not limited to, *Babesia microti, Cryptosporidium parvum, Cyclospora cayetanensis, Plasmodium falciparum, P. vivax, P. ovale, P. malariae*, and *Toxoplasma gondii.*

In some embodiments, the anti-CLEC2D antibody and compositions of the disclosure, is used in a method of treatment of a viral disease in a subject caused by any one or more of (or any combination of) Ebolavirus, measles virus, SARS, Chikungunya virus, hepatitis viruses, Marburg virus, yellow fever virus, MERS, Dengue virus, Lassa fever virus, influenza virus, rhabdovirus or HIV. A hepatitis virus may include hepatitis A, hepatitis B, or hepatitis C.

In some embodiments, the anti-CLEC2D antibody and compositions of the disclosure, is used in a method of treatment of a viral disease in a subject caused by any one or more of (or any combination of) a human respiratory syncytial virus, Sudan ebola virus, Bundibugyo virus, Tai Forest ebola virus, Reston ebola virus, Achimota, Aedes flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyxovirus, Australian bat lyssavirus, Avian bornavirus, Avian metapneumovirus, Avian paramyxoviruses, penguin or Falkland Islandsvirus, BK polyomavirus, Bagaza virus, Banna virus, Bat herpesvirus, Bat sapovirus, Bear Canon mammarenavirus, Beilong virus, Betacoronavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwera virus, Caliciviridae virus. California encephalitis virus, Candiru virus, Canine distemper virus, Canine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, Culex flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyxovirus SF02, Greatlsland virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human genital-associated circular DNA virus-1, Human herpesvirus 1-8, Human immunodeficiency virus 1/2, Human mastadenovirus AG, Human papillomavirus, Human parainfluenza virus 1-4, Human paraechovirus, Human picornavirus, Human smacovirus, Ikoma lyssavirus, Ilheus virus, Influenza A-C, Ippy mammarenavirus, Irkut virus, J-virus, JC polyomavirus, Japanese encephalitis virus, Junin mammarenavirus, KI polyomavirus, Kadipiro virus, Kamiti River virus, Kedougou virus, Khujand virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2Y225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, Montana myotis leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louisencephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno canis virus, Torque teno douroucouli virus, Torque teno felis virus, Torque teno midi virus, Torque teno sus virus, Torque teno tamarin virus, Torque teno virus, Torque teno zalophus virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of diseases caused by RNA viruses that may be treated include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus. In certain embodiments, the virus is retrovirus, including but not limited to one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In some embodiments, the infectious diseases comprises a chronic viral infection, such as HIV. In some embodiments, the infectious disease comprises a chronic bacterial infection such as tuberculosis (TB). In some embodiments, the infectious disease comprises a chronic parasitic infection such as malaria.

In some embodiments, the anti-CLEC2D antibodies or a composition comprising the anti-CLEC2D antibodies of the disclosure, are used in a method of treating a disease or disorder characterized by increased expression of CLEC2D on the surface of various cells of a subject in need thereof, comprising administering to a subject in need thereof one or more anti-CLEC2D antibodies of the disclosure as therapeutic agents in an amount sufficient to either: (i) block binding of the CLEC2D on the various cells to CD161 on the surface of an immune cell; (ii) reduce expression of CLEC2D on the various cells; (iii) reduce expression of one or more genes induced in an immune cell by binding of the CLEC2D to the CD161 on the immune cell (iv) binding to and/or activating one or more Fc receptors on the surface of the immune cell, (v) bind to CLEC2D on the surface of an immune cells and activate the immune cell, or any combination thereof.

In some embodiments, the invention relates to a method of assessing the efficacy of a therapeutic agent in a subject suffering from a cancer or tumor or both, comprising: a) detecting the number of viable and/or proliferating cancer cells in a sample from a subject; b) administering a therapeutically effective amount of one or more anti-CLEC2D antibodies of the disclosure to the subject; c) repeating step a) one or more times; and d) comparing the number of viable and/or proliferating cancer cells detected in steps a) to those detected in step c), wherein the anti-CLEC2D antibodies: (i) bind to CLEC2D on the surface of the cancer cells and inhibits the interaction between the CLEC2D on the tumor cells and CD161 on the surface of immune cells; (ii) bind to CLEC2D on the surface of the cancer cells and Fc receptors on the surface of immune cells to induce lysis of the cancer cell; (iii) bind to CLEC2D on the surface of immune cells and activate the immune cells; or a combination thereof, wherein the absence of, or decrease in number of viable and/or proliferating cancer cells detected in step c) as compared to the number of viable and/or proliferating cancer cells detected in step a) indicates that the agent is effective.

In some embodiments, the anti-CLEC2D antibodies or a composition comprising the anti-CLEC2D and bodies of the disclosure, may enhance the function of mucosal associated invariant T (MAIT) cells, NK cells or T cells.

In some embodiments, the invention relates to a method of treatment of a disease or disorder in a subject, wherein the method comprises administering to the subject in need thereof, a combination of a therapeutically effective amount of an anti-CLEC2D antibody of the disclosure and a therapeutically effective amount of at least a second therapeutic agent. In some embodiments, the at least one second therapeutic agent as disclosed herein, comprises a therapeutic antibody against a protein or antigen expressed on the surface of a tumor cell or immune cell.

In some embodiments, the at least one second therapeutic agent as disclosed herein, comprises a therapeutic antibody against a protein or antigen expressed on the surface of a tumor cell, that induces apoptosis of the tumor cell. In some embodiments, the at least one second therapeutic agent as disclosed herein, comprises a therapeutic antibody against a protein or antigen expressed on the surface of a tumor cell, that induces killing by the immune cell through antibody directed cellular cytotoxicity (ADCC) or complement directed cytotoxicity (CDC). In some embodiments, the at least one second therapeutic agent as disclosed herein, comprises a therapeutic antibody against a protein or antigen expressed on the surface of an immune cell, that induces activation of the immune cell. In some embodiments, the at least one second therapeutic agent as disclosed herein, comprises a therapeutic antibody against a protein or antigen expressed on the surface of an immune cell, that induces cytokine production by the immune cell. In some embodiments, the at least one second therapeutic agent as disclosed herein, comprises a therapeutic antibody against a protein or antigen expressed on the surface of an immune cell, that induces chemokine production by the immune cell. In some embodiments, the at least one second therapeutic agent as disclosed herein, comprises a therapeutic antibody against a protein or antigen expressed on the surface of an immune cell, that induces production of inflammatory cytokines of the immune cell. In some embodiments, the at least one second therapeutic agent as disclosed herein, comprises a therapeutic antibody against a protein or antigen expressed on the surface of an immune cell, that activates the immune cells to recognize and induce cytotoxicity in a cancer cell. In some embodiments, the at least one second therapeutic agent as disclosed herein, comprises a therapeutic antibody against a protein or antigen expressed on the surface of an immune cell, that activates the immune cells to recognize and induce cytotoxicity in cell infected with a pathogen, wherein the pathogen includes but is not limited to a virus or a bacteria.

In some embodiments, the methods of treatment of a disease or disorder in a subject, as disclosed herein, comprises administering the anti-CLEC2D antibodies or a composition comprising the anti-CLEC2D antibodies of the disclosure and at least a second therapeutic agent, sequentially or simultaneously.

Treatment of Inflammatory Diseases

In some embodiments, the disease or disorder treated by the antibodies and pharmaceutical compositions comprising the same of the disclosure comprises an inflammatory or autoimmune disease or disorder.

As used herein, the term "inflammatory disorders" refers to pathological states resulting in inflammation, typically caused by neutrophil chemotaxis.

As used herein, autoimmune diseases or disorders are caused when the body's immune system, which normally defends the body against bacteria, viruses and other infective agents, attacks 'self' tissue, cells and organs. The mobilization of the immune system against such "self" targets is termed autoimmunity. Although some autoimmunity is present in every individual, rigid control systems suppress the self-recognizing cells of the immune system to an extent that the autoimmunity is normally asymptomatic. Disease states arise when there is some interruption in the control system, allowing the autoimmune cells to escape suppression, or when there is some change in a target tissue such that it is no longer recognized as self Autoimmune disorders can be characterized by inflammatory responses.

Exemplary, but non-limiting examples of inflammatory or autoimmune disorders include, but are not limited to seronegative spondyloarthropathies, connective tissue diseases, inflammatory bowel diseases, arthritis, inflammatory skin conditions, inflammatory lung diseases, inflammatory renal disease, systemic vasculitis, macrophage activation diseases, polymyalgia rheumatica, primary biliary sclerosis, sclerosing cholangitis, autoimmune hepatitis, Type 1 Diabetes Mellitus, Hashimoto's thyroiditis, Graves' disease, multiple sclerosis (MS), Guillain-Barre syndrome, Addison's disease, Raynaud's phenomenon and Goodpasture's syndrome.

In some embodiments, a therapeutically effective amount of an antibody of pharmaceutical composition comprising same of the disclosure alleviates or prevents a sign or a symptom of an inflammatory or autoimmune disorder.

In some embodiments, a therapeutically effective amount of an antibody of pharmaceutical composition comprising same of the disclosure reduces an amount of inflammation in one or more tissues or organs of the subject.

In some embodiments, a therapeutically effective amount of an antibody of pharmaceutical composition comprising same of the disclosure transiently reduces or inhibits one or more aspects of the disease or of the immune response. Such a transient inhibition or reduction of one or more aspects of the disease or of the immune system can last for hours, days, weeks, or months. Preferably, the transient inhibition or reduction in one or more aspects of the disease or of the immune response last for a few hours (e.g., 2 hours, 4 hours, 6 hours, 8 hours, 12 hours, 14 hours, 16 hours, 18 hours, 24 hours, 36 hours, or 48 hours), a few days (e.g., 3 days, 4 days, 5 days, 6 days, 7 days, or 14 days), or a few weeks (e.g., 3 weeks, 4 weeks, 5 weeks or 6 weeks).

The prophylactic, therapeutic or immunomodulatory activity of an antibody or pharmaceutical composition comprising an antibody of the disclosure can be determined in vitro and/or in vivo by any technique well-known to one skilled in the art, including, e.g., by CTL assays, proliferation assays, and immunoassays (e.g., ELISAs) for the expression of particular proteins such as co-stimulatory molecules and cytokines.

Treatment of Cancer

As used herein, the term "severity" is meant to describe the potential of cancer to transform from a precancerous, or benign, state into a malignant state. Alternatively, or in addition, severity is meant to describe a cancer stage, for example, according to the TNM system (accepted by the International Union Against Cancer (UICC) and the American Joint Committee on Cancer (AJCC)) or by other art-recognized methods. Cancer stage refers to the extent or severity of the cancer, based on factors such as the location of the primary tumor, tumor size, number of tumors, and lymph node involvement (spread of cancer into lymph nodes). Alternatively, or in addition, severity is meant to describe the tumor grade by art-recognized methods (see, National Cancer Institute, www.cancer.gov). Tumor grade is a system used to classify cancer cells in terms of how abnormal they look under a microscope and how quickly the tumor is likely to grow and spread. Many factors are considered when determining tumor grade, including the structure and growth pattern of the cells. The specific factors used to determine tumor grade vary with each type of cancer. Severity also describes a histologic grade, also called differentiation, which refers to how much the tumor cells resemble normal cells of the same tissue type (see, National Cancer institute, www.cancer.gov). Furthermore, severity describes a nuclear grade, which refers to the size and shape of the nucleus in tumor cells and the percentage of tumor cells that are dividing (see, National Cancer institute, www.cancer.gov).

In another aspect of this disclosure, severity describes the degree to which a tumor has secreted growth factors, degraded the extracellular matrix, become vascularized, lost adhesion to juxtaposed tissues, or metastasized. Moreover, severity describes the number of locations to which a primary tumor has metastasized. Finally, severity includes the difficulty of treating tumors of varying types and locations. For example, inoperable tumors, those cancers Which have greater access to multiple body systems (hematological and immunological tumors), and those which are the most resistant to traditional treatments are considered most severe. In these situations, prolonging the life expectancy of the subject and/or reducing pain, decreasing the proportion of cancerous cells or restricting cells to one system, and improving cancer stage/tumor grade/histological grade/nuclear grade are considered alleviating a sign or symptom of the cancer.

Cancer is a group of diseases that may cause almost any sign or symptom. The signs and symptoms will depend on where the cancer is, the size of the cancer, and how much it affects the nearby organs or structures. If a cancer spreads (metastasizes), then symptoms may appear in different parts of the body.

Treating cancer can result in a reduction in size of a tumor. A reduction in size of a tumor may also be referred to as "tumor regression". Preferably, after treatment, tumor size is reduced by 5% or greater relative to its size prior to treatment; more preferably, tumor size is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Size of a tumor may be measured by any reproducible means of measurement. The size of a tumor may be measured as a diameter of the tumor.

Treating cancer can result in a reduction in tumor volume. Preferably, after treatment, tumor volume is reduced by 5% or greater relative to its size prior to treatment; more preferably, tumor volume is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Tumor volume may be measured by any reproducible means of measurement.

Treating cancer results in a decrease in number of tumors. Preferably, after treatment, tumor number is reduced by 5% or greater relative to number prior to treatment; more preferably, tumor number is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. Number of tumors may be measured by any reproducible means of measurement. The number of tumors may be measured by counting tumors visible to the naked eye or at a specified magnification. Preferably, the specified magnification is 2×, 3×, 4×, 5×, 10×, or 50×.

Treating cancer can result in a decrease in number of metastatic lesions in other tissues or organs distant from the primary tumor site. Preferably, after treatment, the number of metastatic lesions is reduced by 5% or greater relative to number prior to treatment; more preferably, the number of metastatic lesions is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. The number of metastatic lesions may be measured by any reproducible means of measurement. The number of metastatic lesions may be measured by counting metastatic lesions visible to the naked eye or at a specified magnification. Preferably, the specified magnification is 2×, 3×, 4×, 5×, 10×, or 50×.

Treating cancer can result in an increase in average survival time of a population of treated subjects in comparison to a population receiving earlier alone. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an antibody or pharmaceutical composition comprising same. An increase in average survival time of a population may also be measured, for example, by calculating for a population the average length of survival following completion of a first round of treatment with an antibody or pharmaceutical composition comprising same.

Treating cancer can result in an increase in average survival time of a population of treated subjects in comparison to a population of untreated subjects. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an antibody or pharmaceutical composition comprising same. An increase in average survival time of a population may also be measured, for example, by calculating for a population the average length of survival following completion of a first round of treatment with an antibody or pharmaceutical composition comprising same of the present disclosure.

Treating cancer can result in increase in average survival time of a population of treated subjects in comparison to a population receiving monotherapy with a drug that is not an antibody of the present disclosure. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an antibody or pharmaceutical composition comprising same of the present disclosure. An increase in average survival time of a population may also be measured, for example, by calculating for a population the average length of survival following completion of a first round of treatment with an antibody or pharmaceutical composition comprising same of the present disclosure.

Treating cancer can result in a decrease in the mortality rate of a population of treated subjects in comparison to a population receiving carrier alone. Treating cancer can result in a decrease in the mortality rate of a population of treated subjects in comparison to an untreated population. Treating cancer can result in a decrease in the mortality rate of a population of treated subjects in comparison to a population receiving monotherapy with a drug that is not an antibody or a pharmaceutical composition comprising same of the present disclosure. Preferably, the mortality rate is decreased by more than 2%; more preferably, by more than 5%; more preferably, by more than 10%; and most preferably, by more than 25%. A decrease in the mortality rate of a population of treated subjects may be measured by any reproducible means. A decrease in the mortality rate of a population may be measured, for example, by calculating for a population the average number of disease-related deaths per unit time following initiation of treatment with an antibody. A decrease in the mortality rate of a population may also be measured, for example, by calculating for a population the average number of disease-related deaths per unit time following completion of a first round of treatment with an antibody.

Treating cancer can result in a decrease in tumor growth rate. Preferably, after treatment, tumor growth rate is reduced by at least 5% relative to number prior to treatment; more preferably, tumor growth rate is reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Tumor growth rate may be measured by any reproducible means of measurement. Tumor growth rate can be measured according to a change in tumor diameter per unit time.

Treating cancer can result in a decrease in tumor regrowth. Preferably, after treatment, tumor regrowth is less than 5%; more preferably, tumor regrowth is less than 10%; more preferably, less than 20%; more preferably, less than 30%; more preferably, less than 40%; more preferably, less than 50%; even more preferably, less than 30%; and most preferably, less than 75%. Tumor regrowth may be measured by any reproducible means of measurement. Tumor regrowth is measured, for example, by measuring an increase in the diameter of a tumor after a prior tumor shrinkage that followed treatment. A decrease in tumor regrowth is indicated by failure of tumors to reoccur after treatment has stopped.

Treating cancer can result in a reduction in the rate of cellular proliferation. Preferably, after treatment, the rate of cellular proliferation is reduced by at least 5%; inure preferably, by at least 10%; more preferably, by at least 20%; more preferably, by at least 30%; more preferably, by at least 40%; more preferably, by at least 50%; even more preferably, by at least 50%; and most preferably, by at least 75%. The rate of cellular proliferation may be measured by any reproducible means of measurement. The rate of cellular proliferation is measured, for example, by measuring the number of dividing cells in a tissue sample per unit time.

Treating cancer can result in a reduction in the proportion of proliferating cells. Preferably, after treatment, the proportion of proliferating cells is reduced by at least 5%; more preferably; by at least 10%; more preferably, by at least 20%; more preferably, by at least 30%; more preferably, by at least 40%; more preferably, by at least 50%, even more preferably, by at least 50%; and most preferably, by at least 75%. The proportion of proliferating cells may be measured by any reproducible means of measurement. Preferably, the proportion of proliferating cells is measured, for example, by quantifying the number of dividing cells relative to the number of nondividing cells in a tissue sample. The proportion of proliferating cells can be equivalent to the mitotic index.

Treating cancer can result in a decrease in size of an area or zone of cellular proliferation. Preferably, after treatment, size of an area or zone of cellular proliferation is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Size of an area or zone of cellular proliferation may be measured by any reproducible means of measurement. The size of an area or zone of cellular proliferation may be measured as a diameter or width of an area or zone of cellular proliferation. Treating cancer can result in a decrease in the number or proportion of cells having an abnormal appearance or morphology. Preferably, after treatment, the number of cells having an abnormal morphology is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. An abnormal cellular appearance or morphology may be measured by any reproducible means of measurement. An abnormal cellular morphology can be measured by microscopy, e.g., using an inverted tissue culture microscope. An abnormal cellular morphology can take the form of nuclear pleiomorphism.

Treating cancer can result in cell death, and preferably, cell death results in a decrease of at least 10% in number of cells in a population. More preferably, cell death means a decrease of at least 20%; more preferably, a decrease of at least 30%; more preferably, a decrease of at least 40%; more preferably, a decrease of at least 50%; most preferably; a decrease of at least 75%. Number of cells in a population may be measured by any reproducible means. A number of cells in a population can be measured by fluorescence activated cell sorting (FACS), immunofluorescence microscopy and light microscopy. Methods of measuring cell death are as shown in Li et al., Proc Natl Acad Sci USA. 100(5): 2674-8, 2003. In an aspect; cell death occurs by apoptosis.

Monotherapies

In the some embodiments of the disclosure, the antibodies and compositions of the disclosure are administered as monotherapies for the treatment of a disease.

As used herein, "monotherapy" refers to the administration of a single active or therapeutic compound to a subject in need thereof. Preferably, monotherapy will involve administration of a therapeutically effective amount of an active compound. For example, cancer monotherapy with one of the antibodies of the present disclosure, or a pharmaceutical composition thereof, to a subject in need of treatment of cancer. Monotherapy may be contrasted with combination therapy, in which a combination of multiple active compounds is administered, preferably with each component of the combination present in a therapeutically effective amount. In one aspect, monotherapy with an antibody or pharmaceutical composition of the present disclosure is more effective than combination therapy in inducing a desired biological effect.

An antibody according to the disclosure can also be used as an agent for detecting the presence of CLEC2D (or a protein or a protein fragment thereof) in a sample. Preferably, the antibody contains a detectable label. Antibodies can be polyclonal, or more preferably, monoclonal. An intact antibody, or a fragment thereof (e.g., Fab, scFv, or $F_{(ab)2}$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the disclosure can be used to detect an analyte mRNA, protein, or genomic DNA in a biological sample in vitro as well as in vivo. For example, in vitro techniques for detection of an analyte mRNA includes Northern hybridizations and in situ hybridizations. In vitro techniques for detection of an analyte protein include enzyme linked immunosorbent assays (ELISAs), Western blots, immunoprecipitations, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, NJ, 1995; "Immunoassay", E. Diamandis and T. Christopoulus, Academic Press, Inc., San Diego, CA, 1996; and "Practice and Theory of Enzyme Immunoassays", P. Tijssen, Elsevier Science Publishers, Amsterdam, 1985. Furthermore, in vivo techniques for detection of an analyte protein include introducing into a subject a labeled anti-analyte protein antibody. For example, the antibody can be labeled with a radioactive marker whose presence and location in a subject can be detected by standard imaging techniques.

Antibodies directed against a CLEC2D protein (or a fragment thereof) may be used in methods known within the art relating to the localization and/or quantitation of a CLEC2D protein (e.g., for use in measuring levels of the CLEC2D protein within appropriate physiological samples, for use in diagnostic methods, for use in imaging the protein, and the like). In a given embodiment, antibodies specific to a CLEC2D protein, or derivative, fragment, analog or homolog thereof, that contain the antibody derived antigen binding domain, are utilized as pharmacologically active compounds (referred to hereinafter as "Therapeutics").

An antibody specific for a CLEC2D protein of the disclosure can be used to isolate a CLEC2D polypeptide by standard techniques, such as immunoaffinity, chromatography or immunoprecipitation. Antibodies directed against a CLEC2D protein (or a fragment thereof) can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Combination Therapies

In the some embodiments of the disclosure, the antibodies and compositions of the disclosure are administered as part of a combination therapy for the treatment of a disease.

For example, anti-CLEC2D antibodies have been tested in xenograft studies alone and in combination with a check point monoclonal antibody (anti PDL1). The combinatorial treatment with anti-CLEC2D and anti-PDL1 had revealed significant tumor growth reduction. Therefore, Anti-CLEC2D antibody can be used in combination with other therapies for therapeutic purposes.

These therapies include, but are not restricted to, T cell targeted immunomodulatory mechanisms, other immunomodulatory mechanisms, cancer vaccines, adoptive cell therapies, oncolytic viruses, additional antibody therapies including bispecific and other combinations of antibody fragments, radiotherapy, antibody drug conjugates, small interfering RNAs, chemotherapy, immunotherapy, immune checkpoint inhibitors, mitotic inhibitors or a combination thereof.

Chemotherapies, small molecules and biologics that can be administered in combination with an anti-CLEC2D antibodies or compositions of the disclosure include, but are not restricted to hormonal therapies, PARP inhibitors, Androgen receptor inhibitors, tyrosine kinase inhibitors, Abiraterone acetate, Enzalutamide, Apalutamide, Darolutamide, Phosphoinositide 3 Kinase Beta-Selective Inhibitors, Radium 223 Dichloride and other variants, androgen receptor antagonist, CYP17A1 inhibitors, LHRH antagonist, LHRH analogs, Cyclophosphamide, cabazitaxel, Docetaxel, PULP vaccines like Sipuleucel-T, Prostvac, Provange, PSCA, whole cell vaccines and others, therapeutics against PULP surface antigens, Cisplatin, Bispecific antibody-CD3 and ADAM17, pTVG-HP Plasmid DNA Vaccine and other similar vaccines, Tisotumab Vedotin, DCVAC/PCa, GX301, GVAX-PCa and Denosumab.

Chemotherapeutic drugs and anti-cancer agents that can be administered in combination with an anti-CLEC2D antibodies or compositions of the disclosure include, but are not restricted to alkylating agents, antimetabolites, plant alkaloids, vinca alkaloids, mitotic inhibitors, antitumor antibiotics, platinum based anti-neoplastics, topoisomerase inhibitors and protein kinase inhibitors. Exemplary alkylating agents comprise busulfan, cyclophosphamide and temozolamide. Exemplary antimetabolites comprise 5-fluorouracil (5-FU), 6-mercaptopurine (6-MP), Capecitabine (Xeloda) and Gemcitabine. Exemplary anti tumor antibiotics comprise Dactinomycin, Bleomycin, Daunorubicin and Doxorubicin. Exemplary platinum based anti-neoplastics comprise Cisplatin and Carboplatin. Exemplary topoisomerase inhibitors comprise Etoposide, Irinotecan and Topotecan. Exemplary mitotic inhibitors comprise taxanes (e.g., Paclitaxel, Docetaxel), vinca alkaloids (Vinblastine, Vincristine, Vinorelbine) and colchicine. Additional chemotherapeutic agents comprise methotrexate.

Therapeutic agents that can be administered in combination with an anti-CLEC2D antibody or composition comprising the same of the disclosure include, but are not restricted to Orteronel, Geldanamycin, Cabozantinib, Alpharadin, 177Lu-J591, Mitoxantrone, Viamet, CFG920, Galeteron, Olaparib, ADXS-PSA, Taxotere, Gonax, Decapeptyl, Lupron, Vantas, Casodex, Zoladex, Eligard, Leuplin, Firmagon, mitoxantrone, Emcyt, lanreotide, Zaltrap, custirsen sodium and Sprycel.

The Anti-CLEC2D antibodies of the disclosure can be used in combination with monoclonal antibodies or fragments thereof, therapeutic biologics, small molecules or chemical agents that inhibit or modulate the following targets: Cluster of Differentiation 19 (CD19), Programmed cell death protein 1 (PD1), Programmed death-ligand 1 (PDL1), human epidermal growth factor receptor 2 (Her2), Signal transducer and activator of transcription 3 (STAT3), cluster of differentiation 152 (CTLA4), New York esophageal squamous cell carcinoma 1 (NYESO1), B-cell maturation antigen (BCMA), indoleamine 2,3-dioxygenase (IDO), Neo antigens, Colony Stimulating Factor 1 Receptor (CSF1R), B-lymphocyte surface antigen B1 (CD20), Wilms tumor protein (WT1), Cluster of Differentiation 47 (CD47), Mucin 1, cell surface associated (MUC1), TNF receptor superfamily member 9 (4-1BB), disialoganglioside GD2, Adenosine A2a Receptor (ADORA2A), nterferon-alpha/beta receptor alpha chain (IFNAR1), Toll-like receptor 7 (TLR7), Cluster of differentiation 40 (CD40), Mesothelin, epidermal growth factor receptor (EGFR), Histone deacetylase 1 (HDAC1), interleukin-2 receptor (IL2R), Telomerase reverse transcriptase (TERT), Toll-like receptor (TLR), Siglec-3 (CD33), Lymphocyte-activation gene 3 (LAG3), Tumor necrosis factor receptor superfamily, member 4 (OX40), C—X—C chemokine receptor type 4 (CXCR4), Histone deacetylase 6 (HDAC6), prostate-specific membrane antigen (PSMA), Epstein-Barr virus (EBV), granulocyte-macrophage colony-stimulating factor receptor (GMCSFR), Toll-like receptor 9 (TLR9), interleukin-3 receptor (CD123), Stimulator of interferon genes (STING), T-cell immunoreceptor with Ig and ITIM domains (TIGIT), T-cell immunoglobulin and mucin-domain containing-3 (TIM3), Toll-like receptor 4 (TLR4), human papillomavirus gene E6 (HPV-E6), 5'-nucleotidase (CD73), Carcinoembryonic Antigen Related Cell Adhesion Molecule 5 (CEACAM5), Survivin, Cluster of differentiation 3 (CD3), cyclic ADP ribose hydrolase (CD38), glucocorticoid-induced TNFR-related protein (GITR), human papillomavirus E7 oncoprotein (HPVE7), Interleukin 21 Receptor (IL21R), CD137), cluster of differentiation-22 (CD22), tumor necrosis factor receptor superfamily member 8 (CD30), Glypican-3 (GPC3), Beta Catenin, fms-like tyrosine kinase 3 (FLT3), janus kinase 2 (JAK2), Epithelial cell adhesion molecule (EPCAM), Melanoma-Associated Antigen 3 (MAGE-A3), Toll-like receptor 3 (TLR3), human papillomavirus (HPV), K-ras (KRAS), Receptor Tyrosine Kinase Like Orphan Receptor 1 (ROR1), Ubiquitin Specific Peptidase 7 (USP7), Trophoblast glycoprotein (5T4), Interleukin-2 receptor alpha chain (CD25), Cytomegalovirus (CMV), C—X—C Motif Chemokine Ligand 12 (CXCL12), granulocyte colony-stimulating factor receptor (GCSFR), killer cell lectin like receptor K1 (NKG2D), premelanosome protein (PMEL), Preferentially Expressed Antigen In Melanoma (PRAME), V-domain Ig suppressor of T cell activation (VISTA), C-C Motif Chemokine Receptor 4 (CCR4), cluster of differentiation 46 (CD46), Macrophage Stimulating Protein Receptor (CDw136), cyclooxygenase-2 (COX2), SLAM family member 7 (CS1), C—X—C Motif Chemokine Receptor 1 (CXCR1), epidermal growth factor receptor variant III (EGFRvIII), p96, glucocorticoid receptor (GR), Inducible T-cell costimulator (ICOS), Insulin-like growth factor 1 (IGF1), interleukin-5 receptor (IL5R), janus kinase 1 (JAK1), prostate specific antigen (PSA), Signal transducer and activator of transcription 5 (STATS), Transforming Growth Factor Beta Receptor 2 (TGFBR2), Vascular endothelial growth factor (VEGF), Anaplastic lymphoma kinase (ALK), alpha-galactosidase A (Alpha-gal), Cluster of Differentiation 276 (B7-H3), C-C Motif Chemokine Receptor 1 (CCR1), C-C chemokine receptor type 2 (CCR2), CD27 molecule (CD27), ectonucleoside triphosphate diphosphohydrolase 1 (CD39), carcinoembryonic antigen (CEA), Gelactin-3, Interleukin 13 Receptor Subunit Alpha 2 (IL13RA2), Interleukin 6 (IL6), Interleukin 6 Receptor (IL6R), Interleukin 1 Receptor Associated Kinase 4 (IRAK4), MER Proto-Oncogene, Tyrosine Kinase (MERTK), Macrophage migration inhibitory factor (MIF), Protein melan-A (MLANA), Prostaglandin E Receptor 4 (PTGER4), distal-less homeobox 3 (TDO), transforming growth factor beta 1 (TGFB, TGFB1), toll like receptor 2 (TLR2), tumor necrosis factor (TNF), ADORA2B, alpha fetoprotein (AFP), angiopoietin 1 (ANG1), BTLA, prominin 1 (CD133), neural cell adhesion molecule 1 (CD56), CD70 molecule (CD70), carcinoembryonic antigen related cell adhesion molecule 6 (CEACAM6), C-type lectin domain family 12 member A (CLEC12A), C—X—C motif chemokine receptor 2 (CXCR2), fibroblast activation protein alpha (FAP), histone deacetylases (HDAC), interferon alpha and beta receptor subunit 1 (IFNAR), interferon gamma receptor 1 (IFNGR1), interleukin 17 receptor A (IL17R), Janus kinase (JAK), mucin 16, cell surface associated (MUC16), mitogen activated protein kinase (P38), tumor protein p53 (p53), DExD/H-box helicase 68 (RIG1), RAR related orphan receptor C (RORC), signal regulatory protein alpha (SIRPA), transforming growth factor beta receptor 1 (TGFBR1), dopachrome tautomerase (TRP2), adenosine A3 receptor (ADORA3), Brachyury, C-C motif chemokine receptor 7 (CCR7), syndecan 1 (CD138), L1 cell adhesion molecule (CD171), fucosyltransferase 3 (Lewis blood group) (CD174), Fc fragment of IgG receptor IIa (CD32), C-X3-C motif chemokine receptor 1 (CX3CR1), FPHA2, folate receptor 1 (FOLR1), beta-1,3-N-acetylgalactosaminyltransferase 1 (globoside blood group) (GloboH), isocitrate dehydrogenase (NADP(+)) 1, cytosolic (IDH1), interleukin 2 receptor subunit beta (IL2rB), Janus kinase 3 (JAK3), prostate stem cell antigen (PSCA), RAS, transforming growth factor beta 2 (TGFB2), toll like receptor 8 (TLR8), acid phosphatase, prostate (ACPP), dipeptidyl peptidase 4 (ADABP), ADAM metallopeptidase domain 17 (ADAM17), androgen receptor (AR), ATRT, AXL receptor tyrosine kinase (AXL), V-set domain containing T cell activation inhibitor 1 (B7-H4), CA19-9, integrin subunit alpha M (CD11b), Fc fragment of IgG receptor Ma (CD16), CD16a, CD200 molecule (CD200), CD28 molecule (CD28), CD52 molecule (CD52), CD7 molecule (CD7), CD80 molecule (CD80), complement C5a receptor 1 (CD88), cadherin 3 (CDH3), CECAM1, cytochrome c oxidase subunit II (COX2), CCCTC-binding factor like (CTCFL), C—X—C motif chemokine receptor 5 (CXCR5), atypical chemokine receptor 3 (CXCR7), E1a, Gastrin, Graves disease, susceptibility to, X-linked (GD3), Gelactin-1, colony stimulating factor 2 (GMCSF), HBV, HLA-A2, HLA-DR, human papillomavirus (HPV) E6/7, HPV L2, interferon alpha and beta receptor subunit 2 (IFNAR2), insulin like growth factor 1 receptor (IGF1R), interleukin 12 (IL12), interleukin 1 beta (IL1B), interleukin 7 receptor (IL7R), C—X—C motif chemokine ligand 8 (IL8), killer cell immunoglobulin like receptor, two Ig domains and long cytoplasmic tail 1 (KIR2DL1), killer cell immunoglobulin like receptor, two Ig domains and long cytoplasmic tail 3 (KIR2DL3), LXR, CD244 molecule (2B4), Mage family member A (MAGE-A), MAGE family member A1 (MAGE-A1), MAGE family member A4 (MAGE-A4), X-linked inhibitor of apoptosis (MiHA), killer cell lectin like receptor C1 (NKG2A), natural cytotoxicity triggering receptor 1 (NKp46), nuclear receptor subfamily 2 group F member 6 (NR2F6), PTTG1 interacting protein (PBF), sperm adhesion molecule 1 (SPAM1), signal transducer and activator of transcription 1 (STAT1), toll like receptor 5 (TLR5), peroxiredoxin 2 (TSA), tyrosine kinase 2 (TYK2), kinase insert domain receptor (VEGFR2), 5' Nucleotidase, ATP binding cassette subfamily B member 5 (ABCB5), ADAM metallopeptidase domain 9 (ADAMS), Adenosine, ADP, metadherin (AEG1), absent in melanoma 2 (AIM2), Alpha-lactalbumin, anti-Mullerian hormone receptor type 2 (AMHR2), angiopoietin 2 (ANG2), Angiogenesis, aspartate beta-hydroxylase (ASPH), natural killer cell cytotoxicity receptor 3 ligand 1 (B7-H6), TNF receptor superfamily member 13C (BAFF-R), poly(ADP-ribose) polymerase family member 9 (Ball), BRCA1 associated RING domain 1 (BARD1), BCL2 apoptosis regulator (BCL2), POU class 2 associating factor 1 (BOB-1), BTE6-1X-8b, BTE6-X-15-7, KIT proto-oncogene, receptor tyrosine kinase (cKIT), carbonic anhydrase 9 (CA9), Carbohydrate antigens, cannabinoid receptor 2 (CB2), Cbl proto-oncogene B (CBLB), C-C motif chemokine ligand 20 (CCL20), C-C motif chemokine ligand 3 (CCL3), cyclin B1 (CCNB1), C-C motif chemokine receptor 9 (CCR9), alanyl aminopeptidase, membrane (CD13), interleukin 6 signal transducer (CD130), basigin (Ok blood group) (CD147), poliovirus receptor (CD155), CD160 molecule (CD160), selectin P ligand (CD162), CD200 receptor 1 (CD200R1), complement C3d receptor 2 (CD21), TNF receptor superfamily member 13B (CD267), integrin subunit beta 1 (CD29), CD3e molecule (CD3E), CD4 molecule (CD4), CD44 molecule (Indian blood group) (CD44), integrin subunit alpha V (CD51), intercellular adhesion molecule 1 (CD54), CD8a molecule (CD8), CGEN-XXXX, Claudin 18, Claudin 6, MET proto-oncogene, receptor tyrosine kinase (cMet), coproporphyrinogen oxidase (COX), prostaglandin-endoperoxide synthase 1 (COX-1), cytochrome c oxidase subunit I (COX-1), CPEG4, cereblon (CRBN), cytokine receptor like factor 2 (CRLF2), colony stimulating factor 1 (CSF1), phosphate cytidylyltransferase 1, choline, alpha (CTA), C—X—C motif chemokine ligand 1 (CXCL1), C—X—C motif chemokine receptor 3 (CXCR3), deoxycytidine kinase (DCK), dickkopf WNT signaling pathway inhibitor 1 (DKK1), delta like canonical Notch ligand 3 (DLL3), TNF receptor superfamily member 10b (DRS), EBNA3C, epidermal growth factor (EGF), C-type lectin domain containing 14A (EGFR5), eukaryotic translation initiation factor 2 alpha kinase 3 (EIF2AK3), ELVAL4, EPH receptor A3 (EPHA3), epidermal growth factor receptor pathway substrate 8 (EPS8), ERG, Fc fragment of IgM receptor (FAIM-3), fibroblast growth factor 2 (FGF2), fms related tyrosine kinase 3 (FLT3), fibronectin 1 (FN1), folate receptor 1 (FOLR), forkhead box M1 (FOXM1), follicle stimulating hormone receptor (FSHR), Galectin 3, N-acetyl-galactosaminyltransferase (GalNAc), leucine rich repeat containing 32 (GARP), GC vitamin D binding protein (GC), Gelactin 9, Gelactin1/3/9, GM2, gonadotropin releasing hormone receptor (GNRHR), glutamyl aminopeptidase (GP160), golgi membrane protein 1 (GP73), glycoprotein A33 (gpA33), H3.3K27M, DEAD-box helicase 43 (HAGE), histone deacetylase 2 (HDAC2), histone deacetylase 8 (HDAC8), Hemagglutinin, erb-b2 receptor tyrosine kinase 3 (HER3), hypoxia inducible lipid droplet associated (HILPDA), chondroitin sulfate proteoglycan 4 (HMWMAA), HP59, HPV16, HPV11, heat shock protein family H (Hsp110) member 1 (HSP105), heat shock protein family D (Hsp60) member 1 (HSP65), heat shock protein family A (Hsp70) member 4 (HSP70), TNF receptor superfamily member 14 (HVEM), Hyaluronan, indoleamine 2,3-dioxygenase 1 (IDO1), interferon gamma (IFNG), interferon gamma receptor 1 (IFNGR), interferon gamma receptor 2 (IFNGR2), insulin like growth factor 2 (IGF2), insulin like growth factor binding protein 2 (IGFBP2), IGK2, interleukin 10 (IL10), interleukin 10 receptor subunit alpha (IL10RA), interleukin 12 receptor subunit beta 1 (IL12RB1), interleukin (IL13), interleukin 13 receptor subunit alpha 2 (IL13R), interleukin 13 receptor subunit alpha 1 (IL13RA1), interleukin 15 (IL15), interleukin 15 receptor subunit alpha (IL15RA), interleukin 17A (IL17 IL17A), interleukin 17B (IL17B), interleukin 1 receptor type 1 (IL1R1), interleukin 1 receptor accessory protein (IL1R3), interleukin 21 receptor (IL21R), interleukin 27 receptor subunit alpha (IL27R), interleukin 2 receptor subunit alpha (IL2RA), IL35, interleukin 9 receptor (IL9R), Integrin beta 7, interleukin 1 receptor associated kinase 1 (IRAK1), integrin subunit beta 5 (ITGB5), Kappa Myeloma antigen, kinesin family member 20A (KIF20A), killer cell immunoglobulin like receptor, two Ig domains and long cytoplasmic tail 2 (KIR2DL2), Kynurenine, Lambda myeloma antigen, lysosomal associated membrane protein 3 (LAMP), LLO, nuclear receptor subfamily 1 group H member 3 (LXRA), nuclear receptor subfamily 1 group H member 2 (LXRB), MAGEA10 MAGE family member A10 (MAGE-A10), MAGEA6 MAGE family member A6 (MAGE-A6), MAGEC2 MAGE family member C2 (MAGE-C2), Mammaglobin A, mitogen-activated protein kinase (MAPK), Mas receptor, interferon induced with helicase C domain 1 (MDA5), MG7, major histocompatibility complex II (MHCII), MIC, MHC class I polypeptide-related sequence A (MICA), MHC class I polypeptide-related sequence (MICB), matrix metallopeptidase 11 (MMP-11), motile sperm domain containing 2 (MOSPD2), Multidrug resistance-associated protein-1 (MRP1), MRP3765, muGNTP01, major vault protein (MVP), MYB proto-oncogene, transcription factor (MYB), MYB proto-oncogene like 2 (MYBL2), Myeloblastin, MYCN proto-oncogene, bHLH transcription factor (N-myc), nuclear factor of activated T cells (NFAT), NLR family pyrin domain containing 3 (NLRP3), Oncofetal antigen, purinergic receptor P2X 5 (P2RX5), p38 map kinase, phosphoinositide-3-kinase regulatory subunit 3 (P55), PAM4, regenerating family member 3 alpha (PAP), PAS domain containing repressor 1 (PASD1), protocadherin 18 (PCDH18), programmed cell death 1 ligand 2 (PDL2), POTE ankyrin domain family member D (POTE), protein phosphatase 5 catalytic subunit (PPT), prostaglandin E receptor 2 (PTGER2), PVR related immunoglobulin domain containing (PVRIG), RBL001, ras homolog family member C (RhoC), receptor tyrosine kinase like orphan receptor 2 (ROR2), SEREX, SIM bHLH transcription factor 2 (SIM2), somatostatin receptor 2 (SSTR2), SSX family member 2 (SSX2), sterol O-acyltransferase 1

(STAT), eukaryotic translation elongation factor 1 alpha 2 (STn), mRNA cap guanine-N7 methyltransferase (TAG72), TAMA, TASTD2, TD02, transcription factor Dp family member 3 (TFDP3), Thymidylate synthase, DNA topoisomerase I (TOP1), T cell receptor beta constant 1 (TRBC1), T cell receptor beta constant 2 (TRBC2), Tryptophan, thyroid stimulating hormone receptor (TSHR), TNF superfamily member 12 (TWEAK), Tyrosine, lymphocyte antigen 6 family member K (URLC10), retroelement silencing factor 1 (UTA2-1), fms related tyrosine kinase 1 (VEGFR1), V-set and immunoglobulin domain containing 4 (VSIG-4), X antigen family, member 1 (XAGE1), zona pellucida glycoprotein 3 (ZP3), STEAP family member 1 (STEAP1), or TNF superfamily member 11 (RANKL).

In some embodiments, the anti-CLEC2D antibodies or compositions of the disclosure are administered in combination with an immune checkpoint inhibitor, include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1, TIM-3, CEACAM-1, CEACAM-3, or CEACAM-5. In some embodiments, anti-CLEC2D antibodies or compositions of the disclosure are administered in combination with an immune checkpoint inhibitor. Exemplary immune checkpoint genes and therapeutic targets include programmed cell death 1 (PD1), PD-L1, CLTA-4, T cell immunoglobulin and mucin 3 (TIM-3) and lymphocyte activating 3 (LAG-3). In some embodiments, the immune checkpoint inhibitor is a therapeutic antibody that binds to and inhibits PD1, PD-L1 (Programmed death-ligand 1), CLTA-4 or TIM3. Exemplary PD1 inhibitors comprise Pembrolizumab, Nivolumab and Cemiplimab. Exemplary PD-L1 inhibitors comprise Atezolizumab, Avelumab and Durvalumab. Exemplary CLTA-4 inhibitors comprise Ipilimumab.

In some embodiments, the anti-CLEC2D antibodies or compositions of the disclosure are administered in combination with a kinase inhibitor, wherein the kinase inhibitor inhibits BCR-Abl, B-raf, BTK, CDK family, c-Met, EGFR family, JAK family, MEK ½, PDGFR alpha/beta, RET, Src family, or VEGFR family kinases. In some embodiments, the kinase inhibitor as disclosed herein, is a small kinase molecule inhibitor. In some embodiments, the the kinase inhibitor as disclosed herein, is a therapeutic antibody or an antagonistic antibody. In some embodiments, the kinase inhibitor as disclosed herein, is a Crizotinib, Ceritinib, Alectinib, Brigatinib, Bosutinib, Dasatinib, Imatinib, Nilotinib, Ponatinib, Vemurafenib, Dabrafenib, Ibrutinib, Palbociclib, Sorafenib, Ribociclib, Crizotinib, Cabozantinib, Gefitinib, Erlotinib, Lapatinib, Vandetanib, Afatinib, Osimertinib, Ruxolitinib, Tofacitinib, Trametinib, Axitinib, Gefitinib, Imatinib, Lenvatinib, Nintedanib, Pazopanib, Regorafenib, Sorafenib, Sunitinib, Vandetanib, Bosutinib, Dasatinib, Ponatinib, Vandetanib, Axitinib, Lenvatinib, Nintedanib, Regorafenib, Pazopanib, Sorafenib, Sunitinib, or a combination thereof.

In some embodiments, the anti-CLEC2D antibodies or compositions of the disclosure are administered in combination with an anti-CD20 antibody. In some embodiments, the anti-CLEC2D antibodies or compositions of the disclosure are administered in combination with an anti-CD20 antibody, a TNF-receptor antagonist, an anti-TNF-α, or a combination thereof, e.g., for treatment of rheumatoid arthritis. In some embodiments, the anti-CLEC2D antibodies or compositions of the disclosure are administered in combination with anti-CD11a, e.g., for treatment of psoriais, In some embodiments, the anti-CLEC2D antibodies or compositions of the disclosure are administered in combination with IFN-γ, e.g., for treatment of multiple sclerosis. In some embodiments, the anti-CLEC2D antibodies or compositions of the disclosure are administered in combination with TNF-α, e.g., for treatment of ulcerative colitis. In some embodiments, the anti-CLEC2D antibodies or compositions of the disclosure are administered in combination with Infliximab or Natalizumab, e.g., for treatment of Crohn's disease.

In some embodiments, the anti-CLEC2D antibodies or compositions of the disclosure are administered in combination with a multispecific antibody directed against any combination of immune check points gene product and/or target antigens associated with cancer. In some embodiments, the anti-CLEC2D antibodies or compositions of the disclosure are administered in combination with a bispecific antibody directed against any combination of immune check points gene product and/or target antigens associated with cancer.

In some embodiments, the anti-CLEC2D antibodies or compositions of the disclosure are administered in combination with a bispecific antibody directed against an immune check point protein selected from the group consisting of include programmed cell death 1 (PD1), PD-L1, CLTA-4, T cell immunoglobulin and mucin 3 (TIM-3) and lymphocyte activating 3 (LAG-3). In some embodiments, the immune checkpoint inhibitor is a therapeutic antibody that binds to and inhibits PD1, PD-L1 (Programmed death-ligand 1), CLTA-4 or TIM3.

In some embodiments, the anti-CLEC2D antibodies or compositions of the disclosure are administered in combination with a bispecific antibody directed against a tumor antigen selected from the group consisting of: B cell maturation antigen (BCMA); PSA (prostate-specific antigen); prostatespecific membrane antigen (PSMA); PSCA (Prostate stem cell antigen); Tyrosine-protein kinase transmembrane receptor ROR1; fibroblast activation protein (FAP); Tumor-associated glycoprotein 72 (TAG72); Carcinoembryonic antigen (CEA); Epithelial cell adhesion molecule (EP-CAM); Mesothelin; Human Epidermal growth factor Receptor 2 (ERBB2 (Her2/neu)); Prostate; Prostatic acid phosphatase (PAP); elongation factor 2 mutant (ELF2M); Insulin-like growth factor 1 receptor (IGF-1R); gplOO; BCR-ABL (breakpoint cluster region-Abelson); tyrosinase; New York esophageal squamous cell carcinoma 1 (NY-ESO-1); k-light chain, LAGE (L antigen); MAGE (melanoma antigen); Melanoma-associated antigen 1 (MAGE-A1); MAGE A3; MAGE A6; legumain; Human papillomavirus (HPV) E6; HPVE7; prostein; survivin; PCTA1 (Galectin 8); Melan-A/MART-1; Ras mutant; TRP-1 (tyrosinase related protein 1, or gp75); Tyrosinase-related Protein 2 (TRP2); TRP-2/INT2 (TRP-2/intron 2); RAGE (renal antigen); receptor for advanced glycation end products 1 (RAGED; Renal ubiquitous 1, 2 (RU1, RU2); intestinal carboxyl esterase (iCE); Heat shock protein 70-2 (HSP70-2) mutant; thyroid stimulating hormone receptor (TSHR); CD123; CD171; CD19; CD20; CD22; CD26; CD30; CD33; CD44v7/8 (cluster of differentiation 44, exons 7/8); CD53; CD92; CD100; CD148; CD150; CD200; CD261; CD262; CD362; CS-1 (CD2 subset 1, CRACC, SLAMF7, CD319, and 19A24); C-type lectin-like molecule-1 (CLL-1); ganglioside GD3 (aNeu5Ac(2-8)aNeu5Ac(2-3)bDGalp(1-4)bDG1cp(11)Cer); Tn antigen (Tn Ag); Fms-Like Tyrosine Kinase 3 (FLT3); CD38; CD138; CD44v6; B7H3 (CD276); KIT (CD1 17); Interleukin-13 receptor subunit alpha-2 (IL-13Ra2); Interleukin 11 receptor alpha (IL-11Ra); prostate stem cell antigen (PSCA); Protease Serine 2 1 (PRSS21); vascular endothelial growth factor receptor 2 (VEGFR2); Lewis(Y) antigen; CD24; Platelet derived growth factor receptor beta (PDGFR-beta); stage-specific embryonic antigen-4 (SSEA-4); Mucin 1, cell surface associated (MUC1); mucin 16 (MUC1 6); epidermal growth factor receptor (EGFR); epidermal growth factor receptor variant III (EGFRvIII); neural cell adhesion molecule (NCAM); carbonic anhydrase IX (CAIX); Proteasome (Prosome, Macropain) Subunit, Beta Type, 9 (LMP2); ephrin type-A receptor 2 (EphA2); Ephrin B2; Fucosyl GM1; sialyl Lewis adhesion molecule (sLe); ganglioside GM3 (aNeu5Ac(2-3)bDGalp(1-4)bDG1cp(1-1)Cer); TGS5; high molecular weight-melanoma-associated antigen (HMW-MAA); o-acetyl-GD2 ganglioside (OAcGD2); Folate receptor alpha; Folate receptor beta; tumor endothelial marker 1 (TEM1/CD248); tumor endothelial marker 7-related (TEM7R); claudin 6 (CLDN6); G protein coupled receptor class C group 5, member D (GPRCSD); chromosome X open reading frame 6 1 (CXORF61); CD97; CD179a; anaplastic lymphoma kinase (ALK); Poly sialic acid; placenta specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); CT (cancer/testis (antigen)); melanoma cancer testis antigen-1 (MAD-CT-1); melanoma cancer testis antigen-2 (MAD-CT-2); Fos-related antigen 1; p53; p53 mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); NAcetyl glucosaminyl-transferase V (NA17); paired box protein Pax-3 (PAX3); Androgen receptor; Cyclin B1; Cyclin Dl; v-myc avian myelocytomatosis viral oncogene neuroblastoma derived homolog (MYCN); Ras Homolog Family Member C (RhoC); Cytochrome P450 1B1 (CYP1B1); CCCTC-Binding Factor (Zinc Finger Protein)-Like (BORIS); Squamous Cell Carcinoma Antigen Recognized By T Cells-1 or 3 (SART1, SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint-1, -2, -3 or -4 (SSX1, SSX2, SSX3, SSX4); CD79a; CD79b; CD72; Leukocyte-associated immunoglobulin-like receptor 1 (LAIR1); Fc fragment of IgA receptor (FCAR); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module containing mucin-like hormone receptor-like 2 (EMR2); lymphocyte antigen 75 (LY75); Glypican-3 (GPC3); Fc receptor-like 5 (FCRL5); mouse double minute 2 homolog (MDM2); livin; alphafetoprotein (AFP); transmembrane activator and CAML Interactor (TACI); B-cell activating factor receptor (BAFF-R); V-Ki-ras2 Kirsten rat sarcoma viral oncogene homolog (KRAS); immunoglobulin lambda-like polypeptide 1 (IGLL1); 707-AP (707 alanine proline); ART-4 (adenocarcinoma antigen recognized by T4 cells); BAGE (B antigen; b-catenin/m, bcatenin/mutated); CAMEL (CTL-recognized antigen on melanoma); CAP1 (carcinoembryonic antigen peptide 1); CASP-8 (caspase-8); CDC27m (cell-division cycle 27 mutated); CDK4/m (cy-cline-dependent kinase 4 mutated); Cyp-B (cyclophilin B); DAM (differentiation antigen melanoma); EGP-2 (epithelial glycoprotein 2); EGP-40 (epithelial glycoprotein 40); Erbb 2, 3, 4 (erythroblastic leukemia viral oncogene homolog-2, -3, 4); FBP (folate binding protein); fAchR (Fetal acetylcholine receptor); G250 (glycoprotein 250); GAGE (G antigen); GnT-V (Nacetylglucosaminyltransferase V); HAGE (helicose antigen); ULA-A (human leukocyte antigen-A); HST2 (human signet ring tumor 2); KIAA0205; KDR (kinase insert domain receptor); LDLR/FUT (low density lipid receptor/GDP L-fucose: b-D-galactosidase 2-a-L fucosyltransferase); LICAM (LI cell adhesion molecule); MC1R (melanocortin 1 receptor); Myosin/m (myosin mutated); MUM-1, -2, -3 (melanoma ubiquitous mutated 1, 2, 3); NA88-A (NA cDNA clone of patient M88); KG2D (Natural killer group 2, member D) ligands; oncofeta antigen (h5T4); pi 90 minor bcr-abl (protein of 190KD bcr-abl); Pml/RARa (promyelocytic leukaemia/retinoic acid receptor a); PRAME (preferentially expressed antigen of melanoma); SAGE (sarcoma antigen); TEL/AML1 (translocation Ets-family leukemia/acute myeloid leukemia 1); TPI/m (triosephosphate isomerase mutated); CD70; and any combination thereof.

In some embodiments, the anti-CLEC2D antibodies or compositions of the disclosure are administered in combination with a drug or therapeutic agent including but not limited to Mycophenolate, Azathioprine, Cyclophosphamide, Pirfenidone, Nintedanib, Lansoprazole (Prevacid 24HR Omeprazole (Prilosec OTC) and Pantoprazole (protonix), or a combination thereof.

In some embodiments, the anti-CLEC2D antibodies or compositions of the disclosure are administered in combination with a cytokine or chemokine including but not limited to interferon-γ (IFN-γ), tumor necrosis factor-α (TNF-α), granulocyte macrophage colony-stimulating factor (GM-CSF), IL-8, vascular endothelial growth factor (VEGF), stromal cell-derived factor-1, and interferon gamma-inducible protein-10 (IP-10), chemokines (CCL1, CCL2, CCL3, CCL4, CCL5, and CXCL8) or a combination thereof.

In some embodiments, anti-CLEC2D antibodies or compositions of the disclosure are administered in combination with an adoptive cell therapy. In some embodiments, the adoptive cell therapy is autologous. In some embodiments, the adoptive cell therapy is allogenic. In some embodiments, the adoptive cell therapy comprises an immune cell such as a T cell or an NK cell. In some embodiments, the adoptive cell therapy comprises a chimeric antigen receptor T cell (CAR-T) or CAR-NK therapy.

In some embodiments, the CLEC2D antibodies or compositions of the disclosure are administered in combination with adoptive cell therapy comprising a chimeric antigen receptor T cell (CAR-T) directed against target antigens associated with a solid tumor.

In some embodiments, the CLEC2D antibodies or compositions of the disclosure are administered in combination with adoptive cell therapy comprising a chimeric antigen receptor T cell (CAR-T) directed against target antigens associated with cancer, including but not limited to acute lymphoblastic leukemia, diffuse large b-cell lymphoma, follicular lymphoma, chronic lymphocytic leukemia, multiple myeloma, and others.

In some embodiments, the CLEC2D antibodies or compositions of the disclosure are administered in combination with adoptive cell therapy comprising a chimeric antigen receptor T cell (CAR-T) directed against a second antigen is a tumor antigen selected from the group consisting of: B cell maturation antigen (BCMA); PSA (prostate-specific antigen); prostatespecific membrane antigen (PSMA); PSCA (Prostate stem cell antigen); Tyrosine-protein kinase transmembrane receptor ROR1; fibroblast activation protein (FAP); Tumor-associated glycoprotein 72 (TAG72); Carcinoembryonic antigen (CEA); Epithelial cell adhesion molecule (EPCAM); Mesothelin; Human Epidermal growth factor Receptor 2 (ERBB2 (Her2/neu)); Prostate; Prostatic acid phosphatase (PAP); elongation factor 2 mutant (ELF2M); Insulin-like growth factor 1 receptor (IGF-1R); gp100; BCR-ABL (breakpoint cluster region-Abelson); tyrosinase; New York esophageal squamous cell carcinoma 1 (NY-ESO-1); k-light chain, LAGE (L antigen); MAGE (melanoma antigen); Melanoma-associated antigen 1 (MAGE-A1); MAGE A3; MAGE A6; legumain; Human papillomavirus (HPV) E6; HPVE7; prostein; survivin; PCTA1 (Galectin 8); Melan-A/MART-1; Ras mutant; TRP-1 (tyrosinase related protein 1, or gp75); Tyrosinase-related Protein 2 (TRP2); TRP-2/INT2 (TRP-2/intron 2); RAGE (renal antigen); receptor for advanced glycation end products 1 (RAGED; Renal ubiquitous 1, 2 (RU1, RU2); intestinal carboxyl esterase (iCE); Heat shock protein 70-2 (HSP70-2) mutant; thyroid stimulating hormone receptor (TSHR); CD123; CD171; CD19; CD20; CD22; CD26; CD30; CD33; CD44v7/8 (cluster of differentiation 44, exons 7/8); CD53; CD92; CD100; CD148; CD150; CD200; CD261; CD262; CD362; CS-1 (CD2 subset 1, CRACC, SLAMF7, CD319, and 19A24); C-type lectin-like molecule-1 (CLL-1); ganglioside GD3 (aNeu5Ac(2-8)aNeu5Ac (2-3)bDGalp(1-4)bDG1cp(11)Cer); Tn antigen (Tn Ag); Fms-Like Tyrosine Kinase 3 (FLT3); CD38; CD138; CD44v6; B7H3 (CD276); KIT (CD1 17); Interleukin-13 receptor subunit alpha-2 (IL-13Ra2); Interleukin 11 receptor alpha (IL-11Ra); prostate stem cell antigen (PSCA); Protease Serine 2 1 (PRSS21); vascular endothelial growth factor receptor 2 (VEGFR2); Lewis(Y) antigen; CD24; Platelet derived growth factor receptor beta (PDGFR-beta); stage-specific embryonic antigen-4 (SSEA-4); Mucin 1, cell surface associated (MUC1); mucin 16 (MUC1 6); epidermal growth factor receptor (EGFR); epidermal growth factor receptor variant III (EGFRvIII); neural cell adhesion molecule (NCAM); carbonic anhydrase IX (CAIX); Proteasome (Prosome, Macropain) Subunit, Beta Type, 9 (LMP2); ephrin type-A receptor 2 (EphA2); Ephrin B2; Fucosyl GM1; sialyl Lewis adhesion molecule (sLe); ganglioside GM3 (aNeu5Ac(2-3)bDGalp(1-4)bDG1cp(1-1)Cer); TGS5; high molecular weight-melanoma-associated antigen (HMW-MAA); o-acetyl-GD2 ganglioside (OAcGD2); Folate receptor alpha; Folate receptor beta; tumor endothelial marker 1 (TEM1/CD248); tumor endothelial marker 7-related (TEM7R); claudin 6 (CLDN6); G protein coupled receptor class C group 5, member D (GPRCSD); chromosome X open reading frame 6 1 (CXORF61); CD97; CD179a; anaplastic lymphoma kinase (ALK); Poly sialic acid; placenta specific1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); CT (cancer/testis (antigen)); melanoma cancer testis antigen-1 (MAD-CT-1); melanoma cancer testis antigen-2 (MAD-CT-2); Fos-related antigen 1; p53; p53 mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); NAcetyl glucosaminyl-transferase V (NA17); paired box protein Pax-3 (PAX3); Androgen receptor; Cyclin B1; Cyclin Dl; v-myc avian myelocytomatosis viral oncogene neuroblastoma derived homolog (MYCN); Ras Homolog Family Member C (RhoC); Cytochrome P450 1B1 (CYP1B1); CCCTC-Binding Factor (Zinc Finger Protein)-Like (BORIS); Squamous Cell Carcinoma Antigen Recognized By T Cells-1 or 3 (SART1, SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint-1, -2, -3 or -4 (SSX1, SSX2, SSX3, SSX4); CD79a; CD79b; CD72; Leukocyte-associated immunoglobulin-like receptor 1 (LAIR1); Fc fragment of IgA receptor (FCAR); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module containing mucin-like hormone receptor-like 2 (EMR2); lymphocyte antigen 75 (LY75); Glypican-3 (GPC3); Fc receptor-like 5 (FCRL5); mouse double minute 2 homolog (MDM2); livin; alphafetoprotein (AFP); transmembrane activator and CAML Interactor (TACI); B-cell activating factor receptor (BAFF-R); V-Ki-ras2 Kirsten rat sarcoma viral oncogene homolog (KRAS); immunoglobulin lambda-like polypeptide 1 (IGLL1); 707-AP (707 alanine proline); ART-4 (adenocarcinoma antigen recognized by T4 cells); BAGE (B antigen; b-catenin/m, bcatenin/mutated); CAMEL (CTL-recognized antigen on melanoma); CAP1 (carcinoembryonic antigen peptide 1); CASP-8 (caspase-8); CDC27m (cell-division cycle 27 mutated); CDK4/m (cycline-dependent kinase 4 mutated); Cyp-B (cyclophilin B); DAM (differentiation antigen melanoma); EGP-2 (epithelial glycoprotein 2); EGP-40 (epithelial glycoprotein 40); Erbb 2, 3, 4 (erythroblastic leukemia viral oncogene homolog-2, -3, 4); FBP (folate binding protein); fAchR (Fetal acetylcholine receptor); G250 (glycoprotein 250); GAGE (G antigen); GnT-V (Nacetylglucosaminyltransferase V); HAGE (helicose antigen); ULA-A (human leukocyte antigen-A); HST2 (human signet ring tumor 2); KIAA0205; KDR (kinase insert domain receptor); LDLR/FUT (low density lipid receptor/GDP L-fucose: b-D-galactosidase 2-a-L fucosyltransferase); LICAM (LI cell adhesion molecule); MC1R (melanocortin 1 receptor); Myosin/m (myosin mutated); MUM-1, -2, -3 (melanoma ubiquitous mutated 1, 2, 3); NA88-A (NA cDNA clone of patient M88); KG2D (Natural killer group 2, member D) ligands; oncofeta antigen (h5T4); pi 90 minor bcr-abl (protein of 190KD bcr-abl); Pml/RARa (promyelocytic leukaemia/retinoic acid receptor a); PRAME (preferentially expressed antigen of melanoma); SAGE (sarcoma antigen); TEL/AML1 (translocation Ets-family leukemia/acute myeloid leukemia 1); TPI/m (triosephosphate isomerase mutated); CD70; and any combination thereof.

An anti-CLEC2D antibodies of the disclosure may be utilized to form a bispecific antibody, wherein the bispecific antibody specifically binds to CLEC2D and a second antigen, wherein the second antigen is an immune checkpoint inhibitor including but not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1, TIM-3, CEACAM-1, CEACAM-3, or CEACAM-5. In some embodiments, an anti-CLEC2D antibodies of the disclosure, is a bispecific antibody, wherein the bispecific antibody specifically binds to CLEC2D and a second antigen, wherein the second antigen is an immune checkpoint gene and therapeutic target including but not limited to programmed cell death 1 (PD1), PD-L1, CLTA-4, T cell immunoglobulin and mucin 3 (TIM-3) and lymphocyte activating 3 (LAG-3). In some embodiments, an anti-CLEC2D antibodies of the disclosure, is a bispecific antibody, wherein the bispecific antibody specifically binds to CLEC2D and a second antigen, wherein the second antigen is associated with a cytokine or chemokine including but not limited to interferon-γ (IFN-γ), tumor necrosis factor-α (TNF-α), granulocyte macrophage colony-stimulating factor (GM-CSF), IL-8, vascular endothelial growth factor (VEGF), stromal cell-derived factor-1, and interferon gamma-inducible protein-10 (IP-10), chemokines (CCL1, CCL2, CCL3, CCL4, CCL5, and CXCL8) or a combination thereof In some embodiments, an anti-CLEC2D antibodies of the disclosure, is a bispecific antibody, wherein the bispecific antibody specifically binds to CLEC2D and a second antigen on the surface of a host cell. In some embodiments, an anti-CLEC2D antibodies of the disclosure, is a bispecific antibody, wherein the bispecific antibody comprises a first pair of variable light chain and variable heavy chain that specifically binds CLEC2D and a second pair of variable light chain and variable heavy chain that specifically binds to a second antigen on the surface of a host cell. In some embodiments, an anti-CLEC2D antibodies of the disclosure, is a bispecific antibody, wherein the bispecific antibody specifically binds to CLEC2D and a second antigen on the surface of a host cell, wherein the second antigen is an antigen associated with a cancer or tumor cell.

A bispecific antibody, as disclosed herein, may comprise constant regions representing specific isotypes e.g., human IgG1, IgG2, IgG3 and IgG4 or variants thereof, as described in this disclosure. A bispecific antibody, as disclosed herein, may comprise constant regions representing specific isotypes e.g., mouse IgG1, IgG2a, IgG2b or IgG3 or variants thereof, as described in this disclosure. A bispecific antibody, as disclosed herein, may having isotype backbones of IgG1, IgG1N297A and IgG4. A bispecific antibody, as disclosed herein, can be bispecific antibody formats using tri-functional antibody, chemically linked Fab, scFvs or disulfide bonded Fvs include tandem scFvs (often used as bispecific T cell engagers or 'BiTEs'), tetravalent IgG-scFvs, diabodies, and many other formats. In some embodiments, a bispecific antibody, as disclosed herein, is produced as a diabody which are generated by combining sequences encoding two different scFvs into one construct in which heavy chains are expressed in a single polypeptide, and then joined with the corresponding light chains.

In some embodiments, an anti-CLEC2D antibodies of the disclosure, is a bispecific antibody, wherein the bispecific antibody specifically binds to CLEC2D and a second antigen on the surface of a host cell, wherein the second antigen is an antigen associated with a cancer, including but not limited to breast cancer, prostate cancer, endometrial cancer, bladder cancer, kidney cancer, esophageal cancer, squamous cell carcinoma, uveal melanoma, follicular lymphoma, renal cell carcinoma, cendcal cancer, ovarian cancer, lung cancer, colorectal cancer, brain cancer, pancreatic cancer, head and neck cancer, liver cancer, leukemia, lymphoma, Hodgkin's disease, multiple myeloma, melanoma, astrocytoma, stomach cancer, pulmonary adenocarcinoma, adenocarcinoma, acinic cell adenocarcinoma, adrenal cortical carcinomas, alveoli cell carcinoma, anaplastic carcinoma, basaloid carcinoma, basal cell carcinoma, bronchiolar carcinoma, bronchogenic carcinoma, renaladinol carcinoma, embryonal carcinoma, anometroid carcinoma, fibrolamolar liver cell carcinoma, follicular carcinomas, giant cell carcinomas, hepatocellular carcinoma, intraepidermal carcinoma, intraepithelial carcinoma, leptomanigio carcinoma, medullary carcinoma, melanotic carcinoma, menigual carcinoma, mesometonephric carcinoma, oat cell carcinoma, squamal cell carcinoma, sweat gland carcinoma, transitional cell carcinoma, tubular cell carcinoma, ameloblastic sarcoma, angiolithic sarcoma, botryoid sarcoma, endometrial stroma sarcoma, ewing sarcoma, fascicular sarcoma, giant cell sarcoma, granulositic sarcoma, immunoblastic sarcoma, juxaccordial osteogenic sarcoma, coppices sarcoma, leukocytic sarcoma (leukemia), lymphatic sarcoma (lympho sarcoma), medullary sarcoma, myeloid sarcoma (granulocitic sarcoma), austiogenci sarcoma, periosteal sarcoma, reticulum cell sarcoma (histiocytic lymphoma), round cell sarcoma, spindle cell sarcoma, synovial sarcoma, telangiectatic audiogenic sarcoma, Burkitt's lymphoma, NPDL, NML, NH and diffuse lymphomas.

In some embodiments, an anti-CLEC2D antibodies of the disclosure, is a bispecific antibody, wherein the bispecific antibody specifically binds to CLEC2D and a second antigen on the surface of a host cell, wherein the second antigen is an antigen associated with a cancer or tumor cell selected from the group consisting of breast cancer, prostate cancer, endometrial cancer, bladder cancer, kidney cancer, esophageal cancer, squamous cell carcinoma, uveal melanoma, follicular lymphoma, renal cell carcinoma, cendcal cancer, ovarian cancer, lung cancer, colorectal cancer, brain cancer, pancreatic cancer, head and neck cancer, liver cancer, leukemia, lymphoma, Hodgkin's disease, multiple myeloma, melanoma, astrocytoma, stomach cancer, and pulmonary adenocarcinoma. In some embodiments, an anti-CLEC2D antibodies of the disclosure, is a bispecific antibody, wherein the bispecific antibody specifically binds to CLEC2D and a second antigen on the surface of a host cell, wherein the second antigen is a tumor antigen selected from the group consisting of: B cell maturation antigen (BCMA); PSA (prostate-specific antigen); prostatespecific membrane antigen (PSMA); PSCA (Prostate stem cell antigen); Tyrosine-protein kinase transmembrane receptor ROR1; fibroblast activation protein (FAP); Tumor-associated glycoprotein 72 (TAG72); Carcinoembryonic antigen (CEA); Epithelial cell adhesion molecule (EPCAM); Mesothelin; Human Epidermal growth factor Receptor 2 (ERBB2 (Her2/neu)); Prostate; Prostatic acid phosphatase (PAP); elongation factor 2 mutant (ELF2M); Insulin-like growth factor 1 receptor (IGF-1R); gp100; BCR-ABL (breakpoint cluster region- Abelson); tyrosinase; New York esophageal squamous cell carcinoma 1 (NY-ESO-1); k-light chain, LAGE (L antigen); MAGE (melanoma antigen); Melanoma-associated antigen 1 (MAGE-A1); MAGE A3; MAGE A6; legumain; Human papillomavirus (HPV) E6; HPVE7; prostein; survivin; PCTA1 (Galectin 8); Melan-A/MART-1; Ras mutant; TRP-1 (tyrosinase related protein 1, or gp75); Tyrosinase-related Protein 2 (TRP2); TRP-2/INT2 (TRP-2/intron 2); RAGE (renal antigen); receptor for advanced glycation end products 1 (RAGED; Renal ubiquitous 1, 2 (RU1, RU2); intestinal carboxyl esterase (iCE); Heat shock protein 70-2 (HSP70-2) mutant; thyroid stimulating hormone receptor (TSHR); CD123; CD171; CD19; CD20; CD22; CD26; CD30; CD33; CD44v7/8 (cluster of differentiation 44, exons 7/8); CD53; CD92; CD100; CD148; CD150; CD200; CD261; CD262; CD362; CS-1 (CD2 subset 1, CRACC, SLAMF7, CD319, and 19A24); C-type lectin-like molecule-1 (CLL-1); ganglioside GD3 (aNeu5Ac(2-8)aNeu5Ac (2-3)bDGalp(1-4)bDG1cp(11)Cer); Tn antigen (Tn Ag); Fms-Like Tyrosine Kinase 3 (FLT3); CD38; CD138; CD44v6; B7H3 (CD276); KIT (CD1 17); Interleukin-13 receptor subunit alpha-2 (IL-13Ra2); Interleukin 11 receptor alpha (IL-11Ra); prostate stem cell antigen (PSCA); Protease Serine 2 1 (PRSS21); vascular endothelial growth factor receptor 2 (VEGFR2); Lewis(Y) antigen; CD24; Platelet derived growth factor receptor beta (PDGFR-beta); stage-specific embryonic antigen-4 (SSEA-4); Mucin 1, cell surface associated (MUC1); mucin 16 (MUC1 6); epidermal growth factor receptor (EGFR); epidermal growth factor receptor variant III (EGFRvIII); neural cell adhesion molecule (NCAM); carbonic anhydrase IX (CAIX); Proteasome (Prosome, Macropain) Subunit, Beta Type, 9 (LMP2); ephrin type-A receptor 2 (EphA2); Ephrin B2; Fucosyl GM1; sialyl Lewis adhesion molecule (sLe); ganglioside GM3 (aNeu5Ac(2-3)bDGalp(1-4)bDG1cp(1-1)Cer); TGS5; high molecular weight-melanoma-associated antigen (HMW-MAA); o-acetyl-GD2 ganglioside (OAcGD2); Folate receptor alpha; Folate receptor beta; tumor endothelial marker 1 (TEM1/CD248); tumor endothelial marker 7-related (TEM7R); claudin 6 (CLDN6); G protein coupled receptor class C group 5, member D (GPRCSD); chromosome X open reading frame 6 1 (CXORF61); CD97; CD179a; anaplastic lymphoma kinase (ALK); Poly sialic acid; placenta specific1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); CT (cancer/testis (antigen)); melanoma cancer testis antigen-1 (MAD-CT-1); melanoma cancer testis antigen-2 (MAD-CT-2); Fos-related antigen 1; p53; p53 mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); NAcetyl glucosaminyl-transferase V (NA17); paired box protein Pax-3 (PAX3); Androgen receptor; Cyclin B1; Cyclin Dl; v-myc avian myelocytomatosis viral oncogene neuroblastoma derived homolog (MYCN); Ras Homolog Family Member C (RhoC); Cytochrome P450 1B1 (CYP1B1); CCCTC-Binding Factor (Zinc Finger Protein)-Like (BORIS); Squamous Cell Carcinoma Antigen Recognized By T Cells-1 or 3 (SART1, SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint-1, -2, -3 or -4 (SSX1, SSX2, SSX3, SSX4); CD79a; CD79b; CD72; Leukocyte-associated immunoglobulin-like receptor 1 (LAIR1); Fc fragment of IgA receptor (FCAR); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module containing mucin-like hormone receptor-like 2 (EMR2); lymphocyte antigen 75 (LY75); Glypican-3 (GPC3); Fc receptor-like 5 (FCRL5); mouse double minute 2 homolog (MDM2); livin; alphafetoprotein (AFP); transmembrane activator and CAML Interactor (TACI); B-cell activating factor receptor (BAFF-R); V-Ki-ras2 Kirsten rat sarcoma viral oncogene homolog (KRAS); immunoglobulin lambda-like polypeptide 1 (IGLL1); 707-AP (707 alanine proline); ART-4 (adenocarcinoma antigen recognized by T4 cells); BAGE (B antigen; b-catenin/m, bcatenin/mutated); CAMEL (CTL-recognized antigen on melanoma); CAP1 (carcinoembryonic antigen peptide 1); CASP-8 (caspase-8); CDC27m (cell-division cycle 27 mutated); CDK4/m (cycline-dependent kinase 4 mutated); Cyp-B (cyclophilin B); DAM (differentiation antigen melanoma); EGP-2 (epithelial glycoprotein 2); EGP-40 (epithelial glycoprotein 40); Erbb 2, 3, 4 (erythroblastic leukemia viral oncogene homolog-2, -3, 4); FBP (folate binding protein); fAchR (Fetal acetylcholine receptor); G250 (glycoprotein 250); GAGE (G antigen); GnT-V (Nacetylglucosaminyltransferase V); HAGE (helicose antigen); ULA-A (human leukocyte antigen-A); HST2 (human signet ring tumor 2); KIAA0205; KDR (kinase insert domain receptor); LDLR/FUT (low density lipid receptor/GDP L-fucose: b-D-galactosidase 2-a-L fucosyltransferase); LICAM (LI cell adhesion molecule); MC1R (melanocortin 1 receptor); Myosin/m (myosin mutated); MUM-1, -2, -3 (melanoma ubiquitous mutated 1, 2, 3); NA88-A (NA cDNA clone of patient M88); KG2D (Natural killer group 2, member D) ligands; oncofeta antigen (h5T4); pi 90 minor bcr-abl (protein of 190KD bcr-abl); Pml/RARa (promyelocytic leukaemia/retinoic acid receptor a); PRAME (preferentially expressed antigen of melanoma); SAGE (sarcoma antigen); TEL/AML1 (translocation Ets-family leukemia/acute myeloid leukemia 1); TPI/m (triosephosphate isomerase mutated); CD70; or a combination thereof.

In some embodiments, an anti-CLEC2D antibodies of the disclosure, is a bispecific antibody, wherein the bispecific antibody specifically binds to CLEC2D and a second antigen, wherein the second antigen is an antigen associated with an infectious agent or pathogen. In some embodiments, an anti-CLEC2D antibodies of the disclosure, is a bispecific antibody, wherein the bispecific antibody specifically binds to CLEC2D and a second antigen, wherein the second antigen is an antigen associated with a microorganism. In some embodiments, an anti-CLEC2D antibodies of the disclosure, is a bispecific antibody, wherein the bispecific antibody specifically binds to CLEC2D and a second antigen, wherein the second antigen is an antigen associated with a microorganisms including but not limited to bacteria, fungi, protozoa, parasites, and viruses. In some embodiments, an anti-CLEC2D antibodies of the disclosure, is a bispecific antibody, wherein the bispecific antibody specifically binds to CLEC2D and a second antigen, wherein the second antigen is an antigen associated with a microorganisms including but not limited to a pathogenic bacteria, fungi, protozoa, parasites, and viruses. In some embodiments, an anti-CLEC2D antibodies of the disclosure, is a bispecific antibody, wherein the bispecific antibody specifically binds to CLEC2D and a second antigen, wherein the second antigen is an antigen associated with a microorganisms including but not limited to an intracellular bacteria. In some embodiments, an anti-CLEC2D antibodies of the disclosure, is a bispecific antibody, wherein the bispecific antibody specifically binds to CLEC2D and a second antigen, wherein the second antigen is an antigen that is specifically expressed on a host cell infected with a microorganisms including but not limited to a pathogenic bacteria, fungi, protozoa, parasites, and viruses.

In some embodiments, an anti-CLEC2D antibodies of the disclosure, is a bispecific antibody, wherein the bispecific antibody specifically binds to CLEC2D and a second antigen, wherein the second antigen is an antigen associated with inflammatory or autoimmune disorders including but not limited to seronegative spondyloarthropathies, connective tissue diseases, inflammatory bowel diseases, arthritis, inflammatory skin conditions, inflammatory lung diseases, inflammatory renal disease, systemic vasculitis, macrophage activation diseases, polymyalgia rheumatica, primary biliary sclerosis, sclerosing cholangitis, autoimmune hepatitis, Type 1 Diabetes Mellitus, Hashimoto's thyroiditis, Graves' disease, multiple sclerosis (MS), Guillain-Barre syndrome, Addison's disease, Raynaud's phenomenon and Goodpasture's syndrome.

In some embodiments, an anti-CLEC2D antibodies of the disclosure, is a bispecific antibody, wherein the bispecific antibody specifically binds to CLEC2D and a second antigen, wherein the second antigen is an antigen associated with connective tissue diseases such as juvenile rheumatoid arthritis, rheumatoid arthritis, systemic lupus erythematosus (SLE) and lupus nephritis, scleroderma, Sjogren's syndrome, mixed connective tissue disease and polymyositis, dermatomyositis.

In some embodiments, an anti-CLEC2D antibodies of the disclosure, is a bispecific antibody, wherein the bispecific antibody specifically binds to CLEC2D and a second antigen, wherein the second antigen is an antigen associated with Whipples disease and arthritis associated with granulomatous ileocolitis, inflammatory skin conditions such as autoimmune bullous pemphigoid, autoimmune pemphigus vulgaris, eczema and dermatitis, inflammatory lung diseases such as alveolitis, pulmonary fibrosis, sarcoidoisis, asthma, bronchitis and bronchiolitis obliterans, inflammatory renal diseases such as glomerulonethritis, renal allograft rejection and renal tubular inflammation, atherosclerosis, systemic vasculitis such as temporal arteritis/giant cell arteritis, takayasu arteritis, polyarteritis nodosa, Kawasaki disease, Wegener's granulomatosis, churg strauss syndrome, microscopic polyangiitis, necrotising glomerulonephritis, henoch schonlein purpura, essential cryoglobulinaemic vasculitis, other small vessel vasculitis and Behcets disease, macrophage activation diseases such as macrophage activation syndrome (MAS), adult onset stills disease, haemophagocytic syndrome, polymyalgia rheumatica, primary biliary sclerosis, sclerosing cholangitis, autoimmune hepatitis, Type 1 Diabetes Mellitus, Hashimoto's thyroiditis, Graves' disease, multiple sclerosis (MS), Guillain-Barre syndrome, Addison's disease, and/or Raynaud's phenomenon and Goodpasture's syndrome.

The bispecific antibodies of the invention are generated using any methods known in the art such as, by way of non-limiting example, the use of cross-linked fragments, quadromas, and/or any of a variety of recombinant formats such as, by way of non-limiting examples, linked antibody fragments, forced heterodimers, and or recombinant formats based on single domains. Examples of Bispecific formats include but are not limited to bispecific IgG based on Fab arm exchange (Gramer et al., 2013 MAbs. 5(6)); the CrossMab format (Klein C et al., 2012 MAbs 4(6)); multiple formats based on forced heterodimerization approaches such as SEED technology (Davis J H et al., 2010 Protein Eng Des Sel. 23(4):195-202), electrostatic steering (Gunasekaran K et al., J Biol Chem. 2010 285(25):19637-46.) or knob-into-hole (Ridgway J B et al., Protein Eng. 1996 9(7):617-21.) or other sets of mutations preventing homodimer formation (Von Kreudenstein T S et al., 2013 MAbs. 5(5):646-54.); fragment based bispecific formats such as tandem scFv (such asBiTEs) (Wolf E et al., 2005 Drug Discov. Today 10(18):1237-44.); bispecific tetravalent antibodies (Portner L M et al., 2012 Cancer Immunol Immunother. 61(10):1869-75.); dual affinity retargeting molecules (Moore P A et al., 2011 Blood. 117(17):4542-51), diabodies (Kontermann R E et al., Nat Biotechnol. 1997 15(7):629-31).

In some embodiments, the anti-CLEC2D antibodies and compositions and the additional therapeutic agent(s) act additively to treat a sign or a symptom of a disease.

In some embodiments, the anti-CLEC2D antibodies and compositions and the additional therapeutic agent(s) act synergistically to treat a sign or a symptom of a disease.

In some embodiments, the combination of anti-CLEC2D antibodies and compositions with an additional therapeutic agents leads to superior efficacy in the treatment of the disease or disorder, including increased reduction of one or more symptoms of the disease or disorder, the reduction in one or more side effects of the treatment, or a reduction in the therapeutically effective dose of the anti-CLEC2D antibodies or compositions or the additional therapeutic agent.

The antibodies or antigen-binding fragments thereof can be conjugated to another therapeutic modality. The conjugation may bring the antibodies or antigen-binding fragments thereof of the present disclosure into close proximity to the target, such as a target cell, improve the target specificity, increase the overall binding affinity of the conjugate to the target, and/or enhance the cytotoxicity of the NK cells towards the target, which increase the therapeutic efficacy and/or specificity of the antibodies or antigen-binding fragments thereof of the present disclosure. The another therapeutic modality can be any of the additional therapeutic agents described herein. Methods of making antibody conjugates are known in the art, for example, through protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). Coupling may be accomplished by any chemical reaction that will bind the two molecules so long as the antibody and the other moiety retain their respective activities. This linkage can include many chemical mechanisms, for instance covalent binding, affinity binding, intercalation, coordinate binding and complexation. The preferred binding is, however, covalent binding. Covalent binding can be achieved either by direct condensation of existing side chains or by the incorporation of external bridging molecules. Many bivalent or polyvalent linking agents are useful in coupling protein molecules, such as the antibodies of the present invention, to other molecules. For example, representative coupling agents can include organic compounds such as thioesters, carbodiimides, succinimide esters, diisocyanates, glutaraldehyde, diazobenzenes and hexamethylene diamines. This listing is not intended to be exhaustive of the various classes of coupling agents known in the art but, rather, is exemplary of the more common coupling agents. (See Killen and Lindstrom, Jour. Immun. 133:1335-2549 (1984); Jansen et al., Immunological Reviews 62:185-216 (1982); and Vitetta et al., Science 238:1098 (1987).

The antibodies or antigen-binding fragments thereof of the present disclosure can also be used to make a bi-specific antibody. For example, the antibodies or antigen-binding fragments thereof of the present disclosure can be combined with the additional antibodies or antigen-binding fragments thereof described herein to form a bi-specific antibody. Methods of making bispecific antibodies are known in the art.

Dosage regimens are adjusted to provide the optimum desired response, e.g., therapeutic response or minimal adverse effects. For example, for administration of an anti-CLEC2D antibody, the dosage can range from about 0.0001 to about 1000 mg/kg. For example, dosages can be at least 0.1, at least 0.3, at least 1, at least 3, at least 5, at least 10, at least 15, at least 20 or at least 25 mg/kg body weight. The dosing schedule is typically designed to achieve exposures that result in sustained receptor occupancy based on typical pharmacokinetic properties of an antibody. An exemplary treatment regime entails administration once per week, once every two weeks, once every three weeks, once every four weeks, once a month, once every 3 months or once every three to 6 months. The dosage and scheduling may change during a course of treatment. For example, dosing schedule may comprise administering the antibody: (i) every two weeks in 6-week cycles; (ii) every four weeks for six dosages, then every three months; (iii) every three weeks; (iv) with an initial high dose followed by a periodic lower maintenance dose. Intervals between single dosages can be, for example, weekly, every 2 weeks, every 3 weeks, monthly, every three months or yearly. Intervals can also be irregular as indicated by measuring blood levels of antibody to the target antigen in the patient. In some methods, dosage is adjusted to achieve a desired plasma a concentration of the antibody.

In some embodiments, the Ab can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is typically administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably until the patient shows partial or complete amelioration of symptoms of disease. Thereafter, the patient can be administered a prophylactic regime.

Actual dosage levels of the active ingredients in the pharmaceutical compositions of the present disclosure may be varied so as to obtain an amount of the active ingredient which is effective to achieve the desired therapeutic response for a particular patient, composition, and mode of administration, without being unduly toxic to the patient. The selected dosage level will depend upon a variety of pharmacokinetic factors including the activity of the particular compositions of the present disclosure employed, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts. A composition of the present disclosure can be administered via one or more routes of administration using one or more of a variety of methods well known in the art. As will be appreciated by the skilled artisan, the route and/or mode of administration will vary depending upon the desired results.

Diagnosis and Prognosis

The disclosure provides a method of treating a disease in a subject in need thereof, comprising: determining the level of CLEC2D protein in the subject; and administering a therapeutically effective amount of a CLEC2D antibody to the subject. In one embodiment, the level of CLEC2D protein is determined by measuring the level of CLEC2D expression in a cell from the subject. In one embodiment, the cell is a cancer cell (e.g., a cell from a cancer described herein).

The disclosure provides a method of treating a disease in a subject in need thereof, comprising: obtaining a sample from the subject; determining the level of CLEC2D protein in the sample; if the level of CLEC2D protein in the sample is higher than the level of CLEC2D protein in a control sample, administering a therapeutically effective amount of a CLEC2D antibody to the subject. In one embodiment, the sample is a cell from the subject. In one embodiment, the cell is from a diseased tissue or organ. In one embodiment, the cell is a cancer cell (e.g., a cell from a cancer described herein). In one embodiment, the control sample is from a non-diseased tissue or organ of the subject. In one embodiment, the control sample is from a subject which does not have the disease.

The disclosure provides a method of treating a disease in a subject in need thereof, comprising: obtaining a first sample from the subject; determining a first level of CLEC2D protein in the first sample; administering a therapeutically effective amount of a CLEC2D antibody to the subject; obtaining a second sample from the subject; determining a second level of CLEC2D protein in the second sample; comparing the second level with the first level; if the first level is greater than the second level, continuing administration of a therapeutically effective amount of the CLEC2D antibody to the subject. In one embodiment, the sample is a cell from the subject. In one embodiment, the cell is from a diseased tissue or organ. In one embodiment, the cell is a cancer cell (e.g., a cell from a cancer described herein). In one embodiment, the control sample is from a non-diseased tissue or organ of the subject. In one embodiment, the control sample is from a subject which does not have the disease.

The disclosure provides a method of treating a disease in a subject in need thereof, comprising: obtaining a first sample from the subject; determining a first level of CLEC2D protein in the first sample; administering a first therapeutically effective amount of a CLEC2D antibody to the subject; obtaining a second sample from the subject; determining a second level of CLEC2D protein in the second sample; comparing the second level with the first level; if the first level is lower than the second level, administering a second therapeutically effective amount of the CLEC2D antibody to the subject, wherein the second therapeutically effective amount is greater than the first therapeutically effective amount. In one embodiment, the sample is a cell from the subject. In one embodiment, the cell is from a diseased tissue or organ. In one embodiment, the cell is a cancer cell (e.g., a cell from a cancer described herein). In one embodiment, the control sample is from a non-diseased tissue or organ of the subject. In one embodiment, the control sample is from a subject which does not have the disease.

The disclosure provides a method of treating a disease in a subject in need thereof, comprising: obtaining a first sample from the subject; determining a first level of CLEC2D protein in the first sample; administering a therapeutically effective amount of a CLEC2D antibody to the subject; obtaining a second sample from the subject; determining a second level of CLEC2D protein in the second sample; comparing the second level with the first level; if the first level is lower than the second level, terminating administration of the CLEC2D antibody to the subject. In one embodiment, the sample is a cell from the subject. In one embodiment, the cell is from a diseased tissue or organ. In one embodiment, the cell is a cancer cell (e.g., a cell from a cancer described herein). In one embodiment, the control sample is from a non-diseased tissue or organ of the subject. In one embodiment, the control sample is from a subject, which does not have the disease.

The isolated, novel antibody clones can be used to determine stage and aggressiveness of disease and to treat the disease appropriately.

The disclosure provides anti-CLEC2D antibodies and antibody fragments thereof, nucleic acids encoding the antibodies or antigen binding fragments thereof, or compositions comprising same, for use in the diagnosis and prognosis of diseases and disorders.

In some embodiments, isolated monoclonal antibodies reveal the differential expression of CLEC2D on various tumor cell surfaces, indicating that CLEC2D is a novel biomarker for the diagnosis of various disease conditions. Further CLEC2D antigen is significantly overexpressed on various tumors, indicating the usefulness of this target molecule as a novel molecular marker for disease diagnosis. Moreover, the expression level of CLEC2D significantly increases under the influence of various inducing agents. The differential expression of CLEC2D antigen on induced tumor cells is correlated with different stages of disease, disease progression, metastasis, and so on. Therefore CLEC2D has an enormous potential of prognostic biomarker. In some embodiments, an increase in CLEC2D protein expression, for example on a cancer cell in a subject, is associated with a poorer prognostic outcome than if CLEC2D protein expression is not elevated.

As detailed herein, isolated monoclonal antibodies are used to monitor CLEC2D surface expression on tumor cell lines.

Anti-CLEC2D antibodies can be used to diagnose and prognose diseases including, but not limited to breast cancer, prostate cancer, endometrial cancer, bladder cancer, kidney cancer, esophageal cancer, squamous cell carcinoma, uveal melanoma, follicular lymphoma, renal cell carcinoma, cendcal cancer, ovarian cancer, lung cancer, colorectal cancer, brain cancer, pancreatic cancer, head and neck cancer, liver cancer, leukemia, lymphoma, Hodgkin's disease, multiple myeloma, melanoma, astrocytoma, stomach cancer, pulmonary adenocarcinoma, adenocarcinoma, acinic cell adenocarcinoma, adrenal cortical carcinomas, alveoli cell carcinoma, anaplastic carcinoma, basaloid carcinoma, basal cell carcinoma, bronchiolar carcinoma, bronchogenic carcinoma, renaladinol carcinoma, embryonal carcinoma, anometroid carcinoma, fibrolamolar liver cell carcinoma, follicular carcinomas, giant cell carcinomas, hepatocellular carcinoma, intraepidermal carcinoma, intraepithelial carcinoma, leptomanigio carcinoma, medullary carcinoma, melanotic carcinoma, menigual carcinoma, mesometonephric carcinoma, oat cell carcinoma, squamal cell carcinoma, sweat gland carcinoma, transitional cell carcinoma, tubular cell carcinoma, ameloblastic sarcoma, angiolithic sarcoma, botryoid sarcoma, endometrial stroma sarcoma, ewing sarcoma, fascicular sarcoma, giant cell sarcoma, granulositic sarcoma, immunoblastic sarcoma, juxaccordial osteogenic sarcoma, coppices sarcoma, leukocytic sarcoma (leukemia), lymphatic sarcoma (lympho sarcoma), medullary sarcoma, myeloid sarcoma (granulocitic sarcoma), austiogenci sarcoma, periosteal sarcoma, reticulum cell sarcoma (histiocytic lymphoma), round cell sarcoma, spindle cell sarcoma, synovial sarcoma, telangiectatic audiogenic sarcoma, Burkitt's lymphoma, NPDL, NML, NH and diffuse lymphomas.

In spite of various treatment options currently available, multiple cancers, such as breast cancer, prostate cancer, endometrial cancer, bladder cancer, kidney cancer, esophageal cancer, squamous cell carcinoma, uveal melanoma, follicular lymphoma, renal cell carcinoma, cendcal cancer, ovarian cancer, lung cancer, colorectal cancer, brain cancer, pancreatic cancer, head and neck cancer, liver cancer, leukemia, lymphoma, Hodgkin's disease, multiple myeloma, melanoma, astrocytoma, stomach cancer, and pulmonary adenocarcinoma, still remain as leading causes of death in people world-wide and lack unique therapeutic prospects. Diagnosis of these diseases at an early stage is one of the most important factors that determine survival. The present disclosure describes identification of CLEC2D as a biomarker target for these diseases and others, having profound therapeutic implications. The rapid advancement in overall antibody identification methods against CLEC2D, described in present disclosure, have made it possible to validate CLEC2D as novel biomarker against various disease indications mentioned above.

The present disclosure provides anti-CLEC2D antibodies and fragments thereof, and compositions comprising the same, as for use in the identification of CLEC2D expression as a predictive biomarker to stratify patients who are likely to have better response on certain treatments.

The present disclosure provides anti-CLEC2D antibodies and fragments thereof, nucleic acids encoding the antibodies or antigen binding fragments thereof, or compositions comprising the same, as for use in the identification of CLEC2D expression as a predictive biomarker and to pave the way to explore therapies aimed at enhancing NK cells cytolytic activity in metastatic cancer patients. In some embodiments, expression of these CLEC2D receptors on immune cells in the tumor microenvironment is associated with good prognosis. The expression of specific molecules on specific immune cells, such as NK cells and T cells, is involved in maintenance of particular immune function. The present disclosure describes the prognostic role of CLEC2D expression as NK receptor ligands, including in prostate cancer, and the association of CLEC2D expression with different prostate cancer disease stages, molecular subtypes and clinic-pathological features. Blocking CLEC2D expression on tumor cells with an anti-CLEC2D antibody signals in an NK cell mediated cytotoxic immune context and harnesses the positive prognostic value of infiltrating T cells. The human anti-CLEC2D monoclonal antibodies of the disclosure expand the opportunity/scope of these antibodies not only as therapeutic, also, as prognostic and diagnostics in various cancer types either alone or in association with other ligands, cytokines or other cellular factors.

Pharmaceutical Formulations

The disclosure provides a pharmaceutical composition of any of the anti-CLEC2D antibodies or antibody fragments thereof of the disclosure. Each of the anti-CLEC2D antibodies of the present disclosure can be formulated into a composition suitable for administration to the subject. In exemplary aspects, each of the anti-CLEC2D antibodies can be formulated with one or more agents which enhance the chemico-physico features of the anti-CLEC2D antibody, e.g., via stabilizing the anti-CLEC2D antibody at certain temperatures, e.g., room temperature, increasing shelf life, reducing degradation, e.g., oxidation protease mediated degradation, increasing half-life of the anti-CLEC2D antibody, etc. In exemplary aspects of the present disclosure, the anti-CLEC2D antibody may be formulated into a composition additionally comprising a pharmaceutically acceptable carrier, diluents, or excipient.

"Pharmaceutical compostions" and "pharmaceutical formulations" are used interchangeably herein unless the context clearly suggests otherwise.

The pharmaceutical compositions can be solid, semi-solid, or liquid. Generally the pharmaceutical composition is adapted for a particular route of administration. For example, the pharmaceutical composition can be adapted for oral administration, rectal administration, buccal administration, topical administration, etc. Preferably, the pharmaceutical composition is adapted for intravenous administration. In some embodiments the pharmaceutical composition comprising antibodies or antibody fragments of the disclosure is suitable for intravenous injection or infusion. In some embodiments, the aqueous stable monoclonal antibody formulation will be administered by parenteral routes preferably via intramuscular injection, sub-cutaneous injection, i.v. injection or, most preferably, i.v. infusion.

As used herein, a "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). A pharmaceutical composition of this disclosure may include one or more pharmaceutically acceptable salts, anti-oxidant, aqueous and nonaqueous carriers; and/or adjuvants such as preservatives, wetting agents, emulsifying agents and dispersing agents. For example, a pharmaceutically acceptable carrier includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

The pharmaceutical composition can comprise any pharmaceutically acceptable ingredients, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents. Other pharmaceutically acceptable excipients known in the art include diluents, carders, fillers, binders, lubricants, disintegrants, glidants, colorants, pigments, taste masking agents, sweeteners, plasticizers, and any acceptable auxiliary substances such as absorption enhancers, penetration enhancers, surfactants; co-surfactants, preservatives, antioxidants and specialized oils. Specific; to the field of biopharmaceutical proteins are excipients intended to stabilize proteins and cryo-protectants to provide protection during freeze-drying. Suitable excipient(s) are selected based in part on the dosage form, the intended mode of administration, the intended release rate, and manufacturing reliability. Non-limiting examples of commonly used excipients include polymers, waxes, calcium phosphates, sugars (e.g., trehalose, sucrose, or mannitol), buffers (such as phosphate, acetate, citrate, histidine, or glycine based buffers at pH between 5 and 7.5), salts (e.g., NaCl or NaEDTA), polysorbate 20, polysorbate 80; human albumin, dextran, and benzyl alcohol. See, e.g., the Handbook of Pharmaceutical Excipients, Third Edition, A. H. Kibbe (Pharmaceutical Press, London, U K, 2000), which is incorporated by reference in its entirety. Remington's Pharmaceutical Sciences, Sixteenth Edition, E. W. Martin (Mack Publishing Co., Easton, Pa., 1980), which is incorporated by reference in its entirety.

In exemplary aspects, the pharmaceutical composition comprises formulation materials that are nontoxic to recipients at the dosages and concentrations employed. In specific embodiments, pharmaceutical compositions comprising an active agent and one or more pharmaceutically acceptable salts; polyols; surfactants; osmotic balancing agents; tonicity agents; anti-oxidants; antibiotics; antimycotics; bulking agents; lyoprotectants; anti-foaming agents; chelating agents; preservatives; colorants; analgesics; or additional pharmaceutical agents.

In exemplary aspects, the pharmaceutical composition comprises one or more polyols and/or one or more surfactants, optionally, in addition to one or more excipients, including but not limited to, pharmaceutically acceptable salts; osmotic balancing agents (tonicity agents); anti-oxidants; antibiotics; antimycotics; bulking agents; lyoprotectants; antifoaming agents; chelating agents; preservatives; colorants; and analgesics.

In certain embodiments, the pharmaceutical composition can contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL CAR-TSCIENCES, 18" Edition, (A. R. Genrmo, ed.), 1990, Mack Publishing Company.

The pharmaceutical compositions can be formulated to achieve a physiologically compatible pH. In some embodiments, the pH of the pharmaceutical composition can be for example between about 4 or about 5 and about 8.0, between about 4.5 and about 7.5, or between about 5.0 to about 7.5. In exemplary embodiments, the pH of the pharmaceutical composition is between 5.5 and 7.5.

Pharmaceutical compositions for administering the anti-CLEC2D antibodies via parenteral administration are typically liquid. Water is commonly used as a main excipient, although other pharmaceutically-acceptable liquids such as ethanol, glycerol, ethyl oleate, Myglyol benzyol oleate, castor oil, MCT, benzyl alcohol isopropyl myristate can be used alone or in combination with water or each other. Aqueous compositions that contain no other excipients are also contemplated, and can be prepared from lyophilized, amorphous, or crystalline compounds. Often the injectable composition, which can be for subcutaneous, IM, or IV injection, contains isotonizing agents. An injectable solution or suspension is typically sterile, as are all liquid pharmaceutical dosage forms.

Pharmaceutical compositions for administering anti-CLEC2D antibodies via topical administration include powders, creams, ointments, gels, lotions, solutions and suspensions (including mouth washes). The excipient earlier is often aqueous, oil, or polymer based, each optionally in the form of an emulsion or microemulsion. The term "topical administration" includes, for example, optical administration (e.g., via a cream/ointment) and administration to the skin (e.g., at an inflamed joint).

Pharmaceutical compositions for administering anti-CLEC2D antibodies via oral administration include solid oral dosage forms such as tablets, capsules, enteric coated forms thereof, lozenges, and films, as well as liquid dosage forms including solutions, suspensions, liquid filled capsules, and mouth washes. Tablets can be soluble tablets, dispersible tablets, effervescent tablets, chewable tablets, lyophilized tablets, coated tablets (e.g., sugar-coated or enteric-coated), and modified release tablets. Capsules include hard gelatin capsules that can be filled with powder, pellets, granules, small tablets, or mini-tablets, or solutions or emulsions or combinations and can be coated for enteric or modified release. Soft capsules are also contemplated and are more typically filled with liquids, gels or dispersions; but are not limited thereto. Granules can be effervescent granules, coated granules (e.g., sugar-coated or enteric-coated); and modified release granules. Although the anti-CLEC2D antibodies of the present disclosure can be administered orally, it should be understood that such administration may be considered to be a topical administration to the (ii tract. Likewise, a suppository or rectal injection may also be used to topically to the intestines. The use of an oral dosage form to treat gastrointestinal disease(s) using the anti-CLEC2D antibodies of the present disclosure is an aspect of the present disclosure.

An overview of dosage forms can be found in Ansel's Pharmaceutical Dosage forms and Drug Delivery Systems. 9$^{th}$ ed. L. V. Allan, N. G. Popovitch, H. C. Ansel; 2010 Lippincott, ISBN 978-0781779340; Formularium der Nederlandse Apothekers 2004 WINAp ISBN 90-70605-75-9; Recepteerkunde, G. K. Bolhuis, Bouwman-Boer, F. Kadir en J. Zuiderma, 2005 WINAp ISBN 90-70605-65-1; and Apothekenrezeptur und-defektur. Deutscher Apotheker Verlag Stuttgart 1986 ISBN 3-7692-1092-1. See also U.S. Pat. No. 7,147,854 for a description of topical preparations for delivering IL-S antibodies to treat skin inflammatory disease such as psoriasis.

The pharmaceutical composition generally contains about 0.01 to 1000 mg of the antibody per dose, depending in part upon the dosage form employed. The dose can be, for example, fixed or variable (e.g., based on body weight).

Development of a stable formulation is vital to successful clinical manufacturing of pharmaceutical compositions comprising the antibodies and antigen binding fragments of the disclosure.

In some embodiments, a stable formulation is prepared by screening various buffers, stabilizers at different pH with the help of additives and the final stable formulation should contain the physical, chemical stability and biological activity upon storage. The role of excipients in the stable formulation is to prevent and/or reduce the rate of degradation in order to provide an acceptable shelf life.

The current disclosure provides, in some embodiments, a stable liquid and/or lyophilized formulation of anti-CLEC2D monoclonal antibodies. In some embodiments, a formulation buffer contemplated for use in the present disclosure has a pH in the range from 4.0 to 8.0; preferably in the pH range from 4.5 to 7.5; most preferably in the pH range between 5.0 and 6.5.

In some embodiments, the present disclosure comprises buffering agents that can be any of the following and combinations thereof, sodium citrate, citric acid; sodium phosphate mono basic, sodium phosphate dibasic; potassium phosphate mono basic, potassium phosphate dibasic; acetic acid, sodium acetate; histidine, histidine HCl; succinic acid, sodium succinate; tartaric acid, sodium tartrate; maleic acid, maleate; succinate 2-(N-morpholino) ethane sulfonic acid (MES) and hydrochloric acid and sodium hydroxide to adjust the pH to desired range.

In some embodiments, the composition comprises other buffers such as Tris buffer, (3-(N-morpholino)propanesulfonic acid) (MOPS), MOPS-SDS (MEPS), N-cyclohexyl-2-hydroxyl-3-aminopropanesulfonic acid (CAPSO), piperazine-N,N'-bis(2-ethanesulfonic acid) (PIPES) etc. some embodiments, the formulation comprises polyols, which are sugar alcohols. In some embodiments, the stabilizers in the formulation comprise any one of the following alone or in combination: a-trehalose, sucrose, mannitol, sorbitol. In other embodiments, the formulation comprises a second stabilizer that are any one of the following: methionine, lysine, arginine, glycine, glutamate etc.

In some embodiments, the present antibody formulations comprise hydrophobic salts namely sodium camphor sulphate, tri methyl ammonium iodide. In another embodiment, the present disclosure of anti-CLEC2D monoclonal antibody formulation comprises surfactants, as well. In some embodiments, any one of following surfactants are included in the formulations, as exemplified by Polysorbate 20, Polysorbate 40, Polysorbate 80, and Poloxamer 188. In some embodiments, the composition comprising an anti-CLEC2D monoclonal antibody comprises anti-oxidants, for example methionine and/or glutathione. In some embodiments, the composition comprises hydrochloric acid and sodium hydroxide to adjust the pH of formulation buffer.

In some embodiments, the present disclosure comprises other stabilizing and complexing agents such as disodium edetate (Na(2)EDTA) and diethylene triaminepentaacetic acid (DTPA). In some embodiments, all the excipients of the stable formulation are dissolved in water for injection (WFI).

In one embodiment, the final aqueous stable formulation is filtered suitably to remove particulate matter. In some embodiments, filtration is done through either polyethersulfone (PES) filters, Polyvinylidene Fluoride (PVDF) filters or regenerated cellulose (RC) filters, suitably filters sized at either 0.22 and/or 0.45 micron pore size.

In some embodiments, a drug delivery device is the second important aspect of the antibody formulation. In other embodiments, the drug delivery device is sterile. In other embodiments, the drug delivery device is a vial, ampoule, syringe, injection pen or an intravenous (i.v) bag.

In a non-limiting embodiment of the present disclosure, functional characterization comprises performing experiments to understand the kinetics and dynamics of binding of an anti-CLEC2D antibody using techniques that include, but are not limited to, ELISA, BIAcore, flow cytometry, western-blot and imaging, amongst other techniques that are well known in the art. Further CLEC2D-CD161 interaction sites are mapped, and then monitored and validated through flow cytometry based binding experiments.

In a non-limiting embodiment of the present disclosure, monoclonal antibodies function through various mechanisms to destroy tumor cells with an ultimate effect of priming either the innate or adaptive arm of the immune system. The effector functions include complement-dependent cytotoxicity (CDC), antibody-dependent cellular cytotoxicity (ADCC) and antibody-dependent cellular phagocytosis (ADCP). One non-limiting approach employed in the methods disclosed herein is to enhance the efficacy of therapeutic antibodies by modifying the immunoglobulin constant region. An example of such an antibody includes an anti-CLEC2D antibody which consists of a variable region (novel heavy chain and light chain regions) and may consist constant regions representing specific isotypes e.g., IgG1, IgG2, IgG4 or variants thereof, as described in this disclosure. Similarly, the unique variable region sequences could be used to develop antibody molecules with enhanced ADCC function or modified thermal stability as well as developing bispecific antibodies, ScFv molecules or any other antibody formats, as further described herein.

In a non-limiting embodiment of the present disclosure, the phrase "cytokines" may include chemokines, interferons, interleukins, lymphokines and tumor necrosis factors, which may be produced as an effect of the treatment of isolated antibody used against any of the cell lines related to a mentioned disease and/or combination thereof In a non-limiting embodiment of the present disclosure, the phrase an "inducer" is a molecule that regulates gene expression.

An embodiment of the present disclosure comprises using methods and tools to understand interaction of genes associated with pathways such as NK-cell signature, IFN-γ production etc., in relation to a mode of action of selected antibody molecules. To exemplify, techniques such as western blot, flow cytometry, imaging through confocal microscopy and RT PCR are employed together to decipher the mechanistic impact of selected anti-CLEC2D antibody molecules, wherein the effect of various inhibitors against major signaling pathways are assessed in multiple cancer cells. In one embodiment, an IFN-γ release assay, CD107a+ expression, and/or cytoxicity assays are used to estimate the effectiveness of an anti-CLEC2D antibody.

In a non-limiting embodiment of the present disclosure, anti-tumor activity is assessed in huNOG-EXL mice bearing subcutaneous PC3 tumor xenograft, wherein the effect of a selected anti-CLEC2D antibody is monitored either alone or in combination with monoclonal antibody against a checkpoint target. In another embodiment, antibody dosage regimens are adjusted to obtain an optimum and desired anti-tumor response. In some embodiments, the phrases "parenteral administration" or related terms as used herein means mode of administration other than enteral and topical administration, usually by injection and includes, but is not limited to the following administration means, intramuscular, intravenous, intrarterial, intrathecal, intracapsular, intraorbital, intracardiac, intradermal, intraperitoneal, subcutaneous, subcuticular, intraspinal, epidural, intraasternal injection and infusion.

The following examples are presented in order to more fully illustrate the preferred embodiments of this disclosure. They should in no way be construed, however, as limiting the broad scope of this disclosure.

EXAMPLES

Example 1: Expression of Soluble CLEC2D Antigen

The antigen construct comprising an ecto-domain of CLEC2D, either wild type or mutated, was expressed in Chinese hamster ovary (CHO) cell line and purified as a soluble antigen. The CLEC2D ectodomain contains 5 cysteines with 2 putative disulphide bonds. The mutation H176C was carried out to introduce an additional disulphide bridge with the Cys163 amino acid to increase the stability and homogeneity of the expressed protein. The construct was developed with a C-term Histidine tag to facilitate the antigen purification process.

Figure 2A:
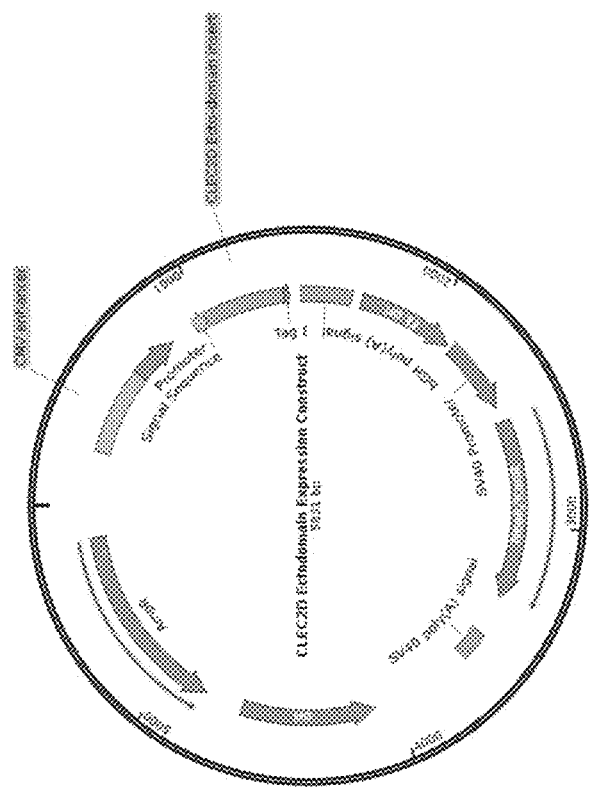
FIG. 2A, generation of mammalian expression plasmids to express CLEC2D ecto-domain as soluble antigen. The construct was generated through gene synthesis followed by confirmation through restriction digestion and Sanger sequencing.
Figure 2B:
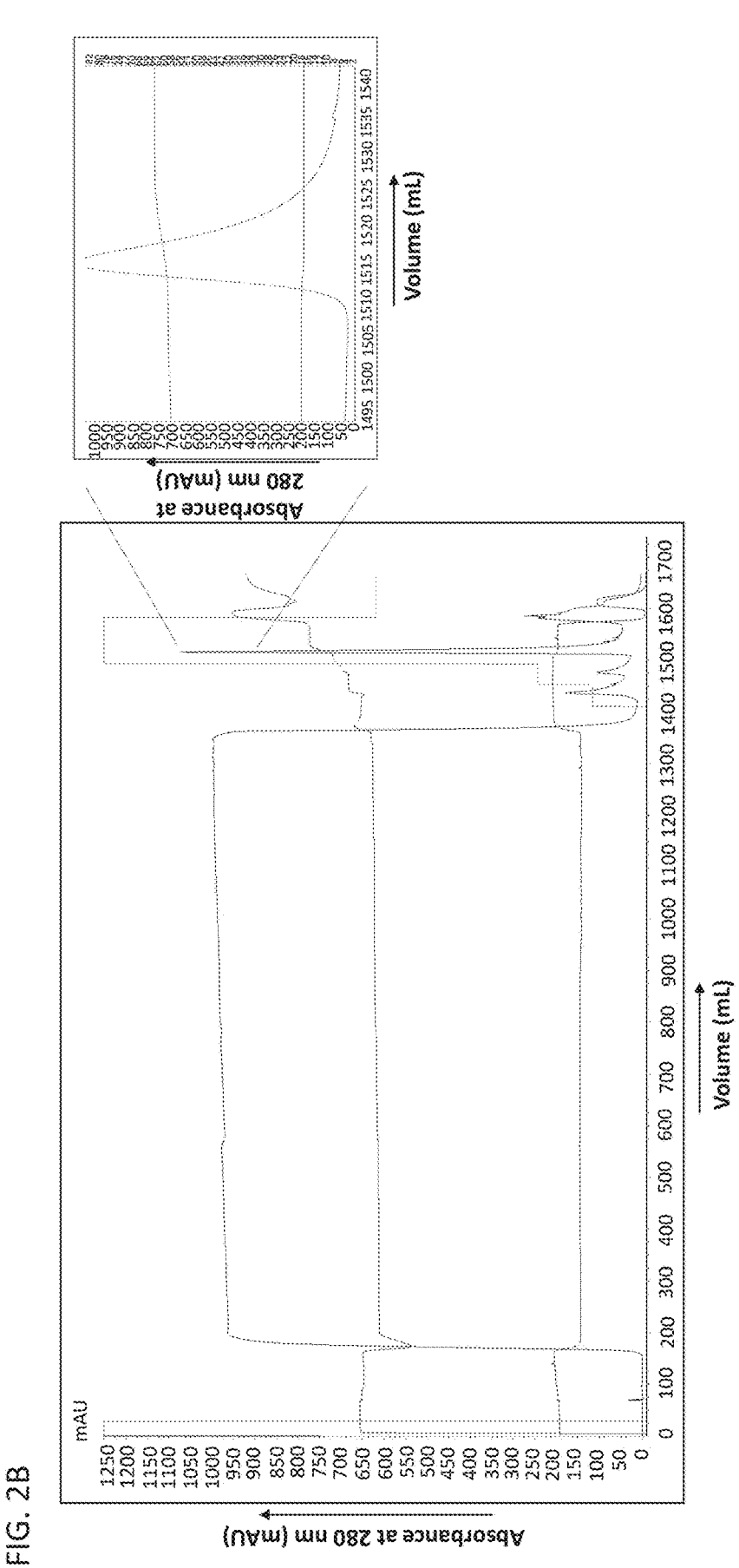
FIG. 2B, IMAC chromatography profile displaying purification of a soluble CLEC2D (Q72-V191), with inset showing elution profile of the CLEC2D antigen.
Figure 2C:
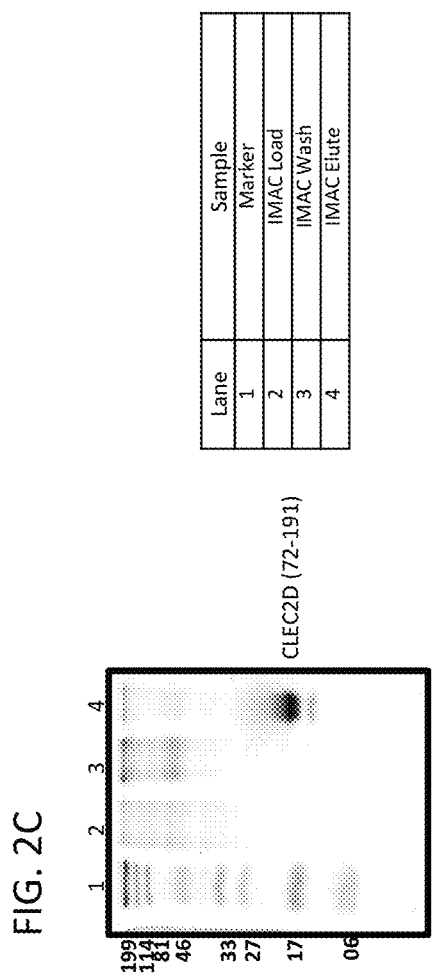
FIG. 2C, SDS-PAGE profile of load, wash and final eluted CLEC2D protein, demonstrating that the purified CLEC2D protein was homogenous and pure, and suitable for further downstream experimentation.
Figures 2D, 2E, 2F:
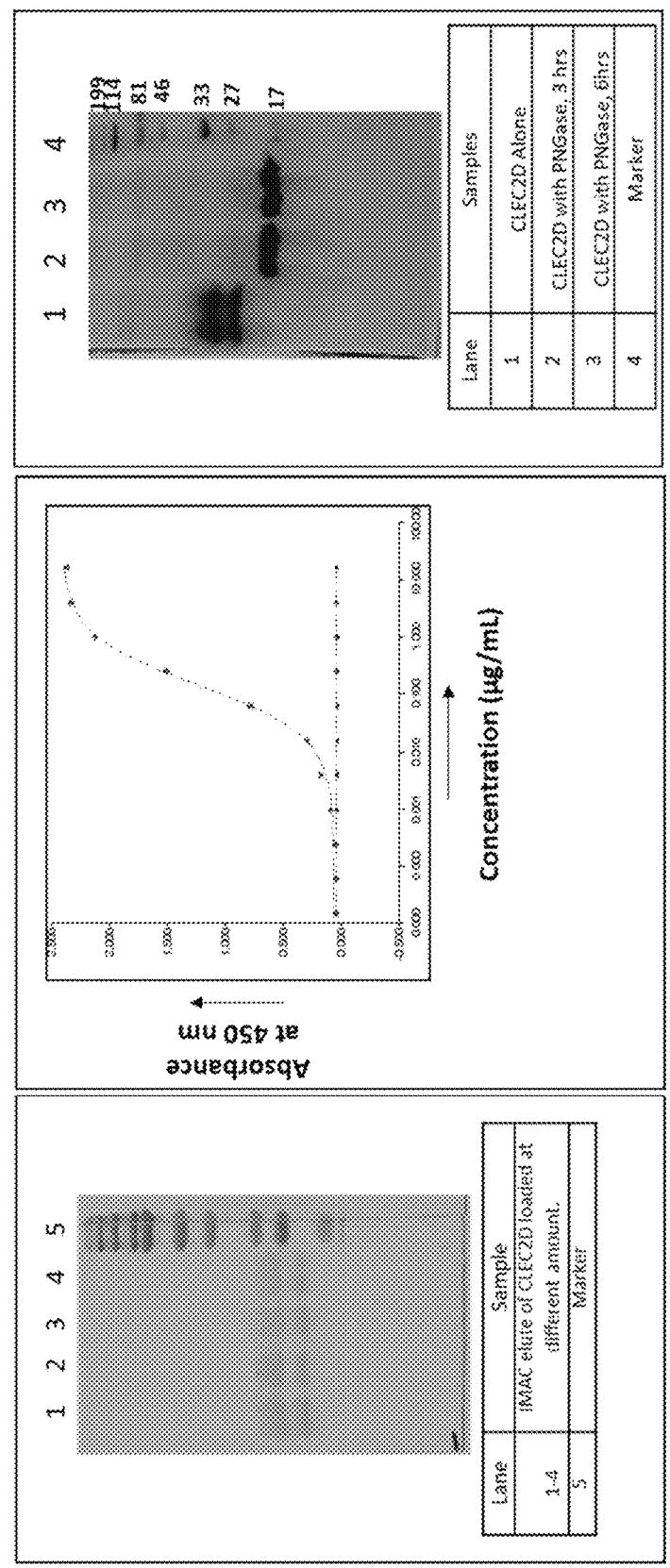
FIG. 2D, western blot of the purified CLEC2D protein, probed with a commercially available antibody against CLEC2D antigen.
FIG. 2E, ELISA assay showing the binding specificity of a commercial antibody against different concentrations of the purified CLEC2D antigen.
FIG. 2F, SDS-PAGE analysis of the purified CLEC2D antigen incubated with PNGase enzyme under reducing conditions for 3 hrs or 6 hrs revealed deglycosylation of CLEC2D antigen.

The extracellular domain of the CLEC2D (Q72-V191, H176C) antigen was codon optimized for both human and CHO expression system and the construct was synthesized. A specific signal sequence was used for secretion of the CHO expressed antigen. The CLEC2D gene sequence and appropriate signal sequence was cloned into the pCDNA3.1 mammalian expression vector (FIG. 2A).

CHO suspension cells at more than 90% viability were used for transfection of the expression plasmid encoding the CLEC2D gene. Cells were centrifuged at 1000-1400 rpm for 4-5 minutes. The spent media was decanted and the cells were re-suspended in 250 ml of OptiMEM I media. The CLEC2D expression plasmid was transfected using Lipofectamine LTX with Plus™ reagent. 500 μg of DNA was used with 1:3 DNA to transfection reagent ratio and 500 μl Plus' reagent was used. DNA and Lipofectamine LTX complex was prepared in 250 ml OptiMEM I and incubated at 20-25° C. for 20 minutes for complex formation. The transfection mix was added slowly to the cell suspension. The cells were incubated for 5 hours at 37° C. in a 5% $CO_2$ shaker incubator at 100-120 RPM. 500 ml of Power CHO2 CD growth media was added to the cells. The cells were incubated for 3 days at 37° C. in a 5% $CO_2$ shaker incubator at 100-120 RPM. Day 3 post transfection 200 ml Power CHO2 CD growth media containing 2 mM Glutamax was added. The cells were incubated at 37° C. in a 5% CO2 shaker incubator at 100-120 RPM. Day 6 post transfection, cell culture supernatant was harvested by centrifugation at 1400-2000 rpm for 10-15 minutes.

The cell harvest was centrifuged and filtrated to remove cell debris. The clear supernatant was loaded onto pre-equilibrated Ni Sepharose FF C10 column. Subsequently the column was washed with 50 mM and 100 mM Imidazole solution sequentially followed by single-step elution of His-tagged CLEC2D protein with 500 mM imidazole. Multiple fractions were collected and buffer exchanged to 1× phosphate buffered saline (PBS) pH 7.4.

Purified CLEC2D antigen was analysed through SDS-PAGE. The human CLEC2D sequence has two putative N-glycosylation sites N95 and N147. The aberrant mobility in SDS-PAGE was speculated to be due to differential N-glycosylation pattern. Purified CLEC2D antigen was de-glycosylated using PNGase enzyme and appeared to be as single band on expected molecular weight as judged by SDS-PAGE analysis (FIGS. 2B-2F). Subsequently purified CLEC2D antigen was analysed by western blot experiments using a commercially available anti-CLEC2D antibody. The purified CLEC2D antigen was also confirmed through ELISA with a commercially available anti-CLEC2D antibody. The oligomeric status of the protein was found to be a dimer using size exclusion chromatography experiments. Finally, N-terminal sequencing was carried out by Edman degradation method to confirm the antigen sequence.

Example 2: Screening of Antibody Gene Library Using Phage and Yeast Display Platforms Screening of antibody gene libraries was carried out with by combining phage display and yeast display of the antibody libraries. Phage and yeast display platforms expressing a human antibody repertoire were used sequentially to identify novel antibody clones with higher affinity and specificity against CLEC2D antigen (FIG. 3). For phage panning experiments against antigens, the magnetic bead based approach was adopted. Antigen coated on magnetic dynabeads were prepared and the efficiency of conjugation was >90%. Phage antibody library was panned against the antigen coated beads to separate phage particles expressing anti-CLEC2D antibody clones. The selected phage particles were used to generate replicative form containing the heavy and light chain repertoire. Purified DNA was digested and ligated into yeast expression vector in two different plasmid constructs to generate antibodies in Fab format and ScFv format.

For magnetic bead conjugation with purified CLEC2D antigen, at first, dyna beads were weighed at a quantity ranging from 0.5 mg to 1.5 mg corresponding to ~0.5-1.0× $10^8$ beads and dissolved into 0.1 M sodium phosphate buffer, pH 7.4. This suspension was vortexed for 30-60 seconds followed by incubation at room temperature for 10-15 minutes with continuous rotation. The suspension was washed twice with 0.1 M sodium phosphate buffer and re-suspended again into 100 µL of 0.1 M sodium phosphate buffer. 5-10 µg of purified soluble CLEC2D antigen solution, (75-150 µL) was added to the bead suspension. Further, the suspension was mixed well before adding the 100 µL of 3 M ammonium sulfate solution. The mixture was incubated for 15-20 hours at 30-37° C. with slow tilt but continuous rotation. Post incubation the tube was placed on the magnet holder for 1 min for magnetic separation. The magnet holder (with the tube in place) was carefully turned upside-down twice to ensure no beads remain in the cap. The supernatant was removed and beads are washed four times with 1 mL 1×PBS containing BSA (0.05%). Finally, the beads are re-suspended in 100 µL of 1×PBS with BSA (0.05%) and are used in panning.

Figure 4A:
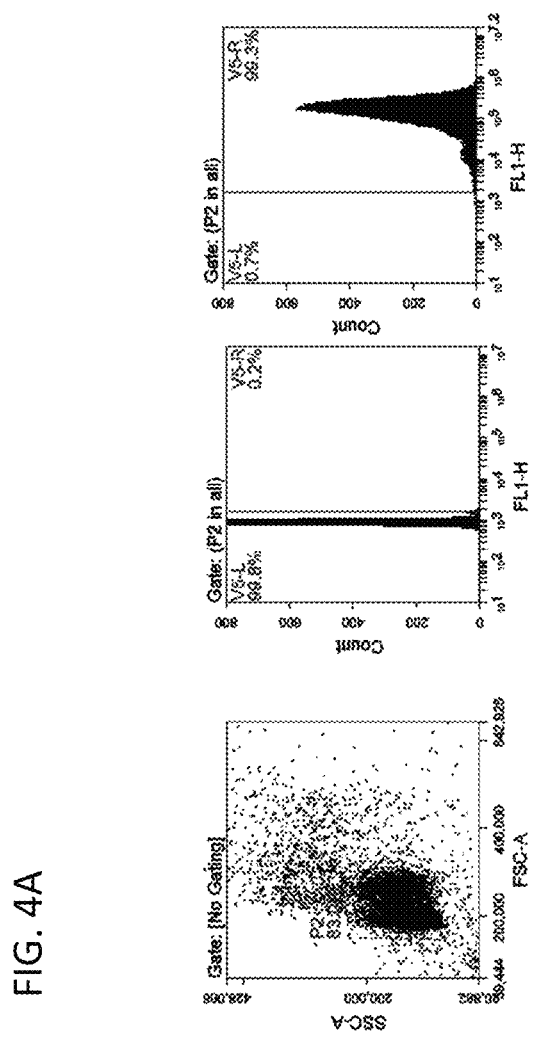

1 µL (~$10^6$ number of beads) of bead alone and bead coated with CLEC2D antigen are mixed with commercial P4500/anti-CLEC2D antibody at amount of 0.1 µg followed by volume make up to 100 µL with 1×PBS containing 0.5% BSA. The mixture was incubated for 2 hrs on ice followed by a washing with 1×PBS containing 0.5% BSA. Anti-goat IgG conjugated with FITC at 1:400 dilution was added to the re-suspended beads in solution of 1×PBS containing 0.5% BSA to a volume of 100 µL before readings were taken. All the flow cytometry experiments were done using Accuri C6 flow cytometer while the analysis was done by using BD Accuri C6 software. Firstly, forward and side scatter data was seen to fix a gate followed by fluorescence reading through FLH1 filter. At least 5,000-10,000 data points are collected for each sample (FIG. 4A).

Phage panning experiment was started with inoculation of single colony from the freshly streaked TG1 bacterial plate into 3 ml LB medium followed by incubation at 37° C. until OD600≈0.9 and this was used for phage infection later. A phage naïve antibody library was thawed and the phage particles are precipitated with 250 µl (~¼ of the phage suspension volume) PEG/NaCl solutions (20% PEG 8000 and 2.5 M NaCl) and incubated on ice for 30 minutes followed by centrifugation of the precipitated phage at 10,000×g for 10 minutes. The supernatant was discarded and the phage pellet was re-suspended in 200 µl PBS solution. Phage suspension (200 µl) was added to the bead conjugated with BSA and incubated on a rotator at room temperature for 2 hrs followed by adding the supernatant to bead conjugated with CLEC2D antigen and 10 µL of supernatant was kept aside for plaques assay later on. Phage suspension with conjugated bead with antigen was incubated on a rotator at room temperature for 2 hrs. The beads were washed two times with 1 ml 0.05% PBST (0.05% Tween-20 in PBS). Finally, magnetic beads bound with phage particle are re-suspended in 100 µl PBS. 10 µL of beads suspension was kept aside for plaques assay later on. The remaining 90 µl of the suspension was added to 2 ml of grown TG1 cells prepared earlier and the mixture was incubated at 37° C. for 1 h. Post incubation it was diluted into 10 ml LB medium containing ampicillin at a final concentration of 25 µg/ml. After two hours of incubation at 37° C. with constant shaking at 250 rpm, concentration of ampicillin was increased to a final concentration of 100 µg/ml. M13K07, helper phage, was mixed into the amplified TG1 cells with multiplicity of infection (MOI) of 10 and incubated at 37° C. for another 30 minutes. Helper phage-infected bacteria was spun down and the pellet was re-suspended into 10 ml of LB medium supplemented with 100 µg/ml ampicillin and 25 µg/ml kanamycin followed by incubation at 30° C. for 30 minutes to 100 minutes for phage amplification. The bacterial culture was pelleted down by centrifugation for 10 minutes at 10,000 g. The pellet was discarded and supernatant was used for precipitation of amplified phage molecules by adding PEG/NaCL solution to the supernatant (~¼th volume of supernatant). The mixture was incubated for 30 min on ice, followed by spinning the precipitated phage at 10,000 g for 10 minutes. Supernatant was discarded and pellet was re-suspended in 1 ml of PBS. The Plaques assay was performed from the 10 µL of amplified phage suspension to estimate the amplified phage number while the remaining of the precipitated phage are stored with 50% glycerol at −80° C. freezer for long term storage.

Plaque assay was performed at every step to ensure the numbers of phage particles. A single colony from the TG1 bacterial plate was inoculated in bacteria in 3 ml LB medium and was grown at 37° C. until OD600≈0.9. 0.7% of agarose was prepared in purified water and stored at 50° C. in aliquots of 3 ml each in a 15 ml of falcon tubes. The phage supernatant and pellet were diluted at respective steps from $10^{-1}$ to $10^{-5}$. 100 µl of diluted phage and 100 µl TG1 cells were added in to each of agarose aliquots and mixed followed by immediately spreading on LB Agar plate. The plates were incubated in 37° C. in an incubator for overnight. The plaque formation was observed and counted next day. The number of panned molecules was calculated based on number of plaques observed (Table 10).

TABLE 10

Estimation of phage particle number at every step of panning process against CLEC2D antigen.

| Process Step | Pfu/mL |
|---|---|
| Panning with BSA conjugated beads | $4 \times 10^8$ |
| Supernatant from BSA panning | $1 \times 10^9$ |
| CLEC2D binders | $4 \times 10^6$ |

Single colony from the TG1 bacterial plate was inoculated into 20 ml LB medium at 37° C. until OD600 reaches ~0.9. 200 µl of the precipitated panned phage suspension was inoculated into 2 ml TG1 cells (in 10 different tubes and each tube contains 2-5 ml of TG1 cells) followed by incubating the mixture at 37° C. with shaking for 1 hour. Volume in each tube was diluted into 10 ml LB medium containing 25 µg/ml Ampicillin. Following additional 2 hours of incubation at 37° C. with shaking at 220 rpm, ampicillin concentration was increased to a final concentration of 100 µg/ml and incubated further for 30 minutes to 100 min. Bacterial culture was spun down at 10,000 g for 10 minutes, and the pellet was used for DNA isolation through Qiagen midi prep as per manufacturer's protocol for further use.

Figure 4C:
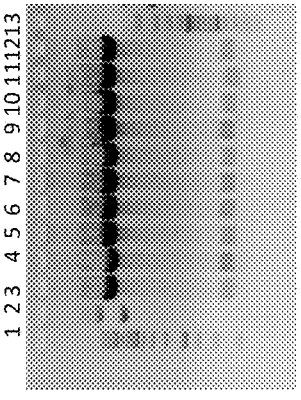
Figure 4B:
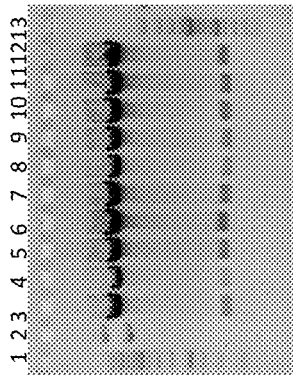

Construction of heavy and light chain libraries in to yeast shuttle vectors in Fab format:

Isolated replicative form DNA of panned molecules along with the in-house yeast expression vector pZB003 (MTCC 25127) designated for light chain incorporation are digested with HindIII and AscI followed by ligation and transformation individually into TG1, highly competent cells. Likewise, heavy chain pool (sourced from isolated replicative form) and the respective vector pZB002 (MTCC 25126) are digested with NcoI and NotI followed by ligation and transformation into TG1, highly competent cells. Transformation efficiency obtained for both heavy and light chain panned library are >$10^7$ cfu. Obtained transformed colonies for both heavy and light chain libraries are checked for insert release using NcoI/NotI for heavy chain (FIG. 4B) and HindIII/AscI for light chain (FIG. 4C) before they are scraped for glycerol stock preparation. Insert release for both the chains confirmed the presence of panned variable heavy and light chain-kappa molecules. Glycerol stocks are stored at −80° C. for future use. Tables 10, 11 and 12 provide for components applicable in constructing libraries in yeast vectors.

Table 11

| Components | Amount/Volume |
|---|---|
| DNA | 20 ug |
| NcoI | 4 uL |
| NotI | 4 uL |
| CutSmart Buffer | 10 |
| Water | Respective Volume |
| Total | 100 uL |

TABLE 12

| Components | Amount/Volume |
|---|---|
| DNA | 20 ug |
| HindIII | 4 uL |
| AscI | 4 uL |
| CutSmart Buffer | 10 |
| Water | Respective Volume |
| Total | 100 uL |

TABLE 13

| Components | Amount/Volume |
|---|---|
| Vector | 100 ng |
| Insert | 100 ng |
| T4 DNA ligase | 0.5 uL |
| T4 DNA ligase Buffer | 2 uL |
| Water | Respective Volume |
| Total | 20 uL |

Construction of Heavy and Light Chain Libraries in to Yeast Shuttle Vectors in ScFv Format:

ScFv format comprises of transfer of light chain (kappa repertoire originated from panned phage against CLEC2D antigen) into pZB004.4 vector between NdeI and AscI restriction sites followed by generation of a pool of light chain ScFv library. Subsequently the library was confirmed with restriction digestion confirmation followed by transfer of panned heavy chain pool into ScFv-light chain library between NcoI and NotI restriction enzymes. This final library was used as ScFv library of panned molecules which will be further transformed, sorted and screened in yeast expression system. Isolated replicative form DNA of panned molecules along with the in-house ScFv yeast expression vector are digested with NdeI and AscI followed by ligation and transformation individually into TG1, highly competent cells.

Obtained transformed colonies for light chain libraries are checked for insert release using NdeI/AscI before they are scraped for glycerol stock preparation. Insert release confirmed the presence of panned molecules. Glycerol stocks are stored at −80° C. for future use. Plasmid isolation was carried out using Qiagen midi prep kit which will be used for incorporation of heavy chain repertoire obtained from panning.

Figure 4D:
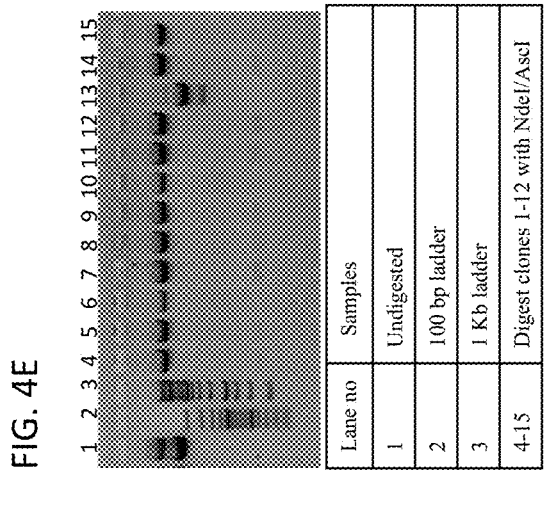
Figure 4E:
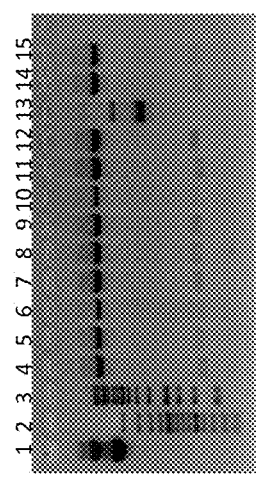

Likewise, heavy chain pool from isolated replicative form and the ScFv containing light chain library are digested with NcoI and NotI (FIG. 4D) followed by ligation and transformation into TG1, highly competent cells. Transformation efficiency obtained for both heavy and light chain panned library are >$10^7$ cfu. Colonies were confirmed with insert release for both heavy with NcoI/NotI and light chains with NdeI/AscI (FIG. 4E).

Tables 13, 14 and 15 provide for components applicable in constructing libraries in yeast expression vector.

TABLE 14

| Components | Amount/Volume |
|---|---|
| DNA | 20 ug |
| NdeI | 4 uL |
| AscI | 4 uL |
| CutSmart Buffer | 10 |
| Water | Respective Volume |
| Total | 100 uL |

TABLE 15

| Components | Amount/Volume |
|---|---|
| DNA | 20 ug |
| NcoI | 4 uL |
| NotI | 4 uL |
| CutSmart Buffer | 10 |
| Water | Respective Volume |
| Total | 100 uL |

TABLE 16

| Components | Amount/Volume |
|---|---|
| Vector | 100 ng |
| Insert | 100 ng |
| T4 DNA ligase | 0.5 uL |
| T4 DNA ligase Buffer | 2 uL |
| Water | Respective Volume |
| Total | 20 uL |

DNA isolated in large scale was checked for restriction digestion, before transferred for yeast transformation. Post confirmation through restriction digestion at least 10 independent clones containing variable heavy and light-kappa chains for each of formats were sent for sequencing reactions. The sequencing results have been summarized in terms of productive heavy and light-kappa chains in the following Table 17.

TABLE 17 summarizes the percentage productivity for variable heavy chain and light-kappa chain as estimated from sequencing reactions carried out from independent clones.

| Antigen | Format | Chain Type | Productivity |
|---|---|---|---|
| CLEC2D | Fab | Variable heavy chain pool | 81% |
| | | Variable Light chain Pool | 80% |
| | ScFv | Heavy and Light chain repertoire | 85% |

As detailed above, phage antibody library was panned against the CLEC2D antigen coated beads in order to eliminate non-specific binders. The selected phage particles were used to generate replicative form containing the heavy and light chain repertoire. This method was devoid of any PCR based approached which might introduce unwanted biasness towards the panned pool of molecules. Purified replicative form of DNA was digested and ligated into yeast expression vector in two different plasmid constructs to generate antibody in Fab format and ScFv format, wherein the cloning efficiency was estimated to be >95% and the efficiency of TG1 cells transformation was more than $10^7$ cfu. These parameters were essential to meet to ensure complete capturing of panned diversity.

Subsequently, yeast DNA libraries in both formats i.e., ScFv and Fab, were transformed into yeast cells. Transformed yeast cells were checked for heavy chain, light chain and Fab molecule expression. Surface expression of antibody genes were analysed with multiple tags such as FLAG, c-Myc and $(His)_6$-tag and V5-tag for heavy chains and light chains, respectively. Flow cytometry based sorting was carried out to isolate yeast cells expressing antibody sequences showing specific antigen binding ( )). Flow sorting of yeast cell populations were repeated 2-3 times to enrich antibody clones with higher affinity towards labelled CLEC2D antigen.

Generation of Yeast ScFv Library

EBY100 strain (*S. cerevisiae* cells) was grown for overnight in to 5 ml YPD media on a platform shaker at 220 rpm and 30° C. The next morning, an aliquot of the overnight culture was inoculated into 100 ml YPD media at OD600~0.3. The inoculated cells continued to grow on a platform shaker at 30° C. and 220 rpm until OD600 reached to ~1.6 (usually after 5 hours-6 hours). Yeast cells were collect by centrifugation at 3000 rpm for 3 minutes and the media was removed. The cell pellet was washed twice with 50 ml ice cold water and once by 50 ml of ice cold electroporation buffer (1 M Sorbitol/1 mM $CaCl_2$). The yeast cells were condition by re-suspending the cell pellet in 20 ml (0.1 M LiAc/10 mM DTT) and shaking at 220 rpm in a culture flask for 30 minutes at 30° C. The conditioned cells were collected by centrifugation, washed once with 50 ml ice-cold electroporation buffer and re-suspended the cell pellet in 100 µl to 200 µl electroporation buffer to reach a final volume of 1 ml.

Figure 5A:
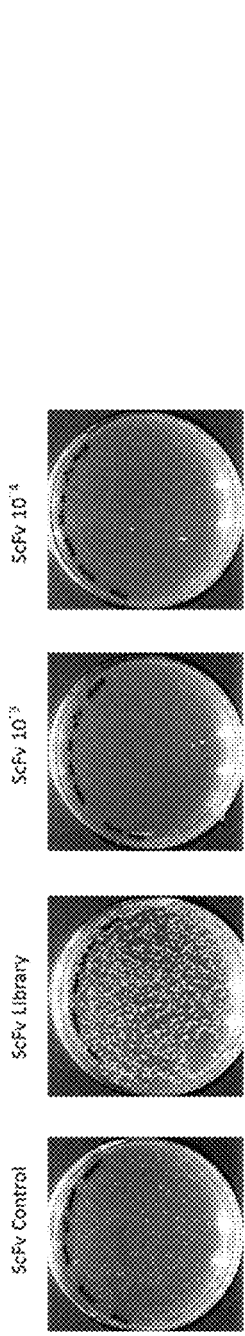
Figure 5B:
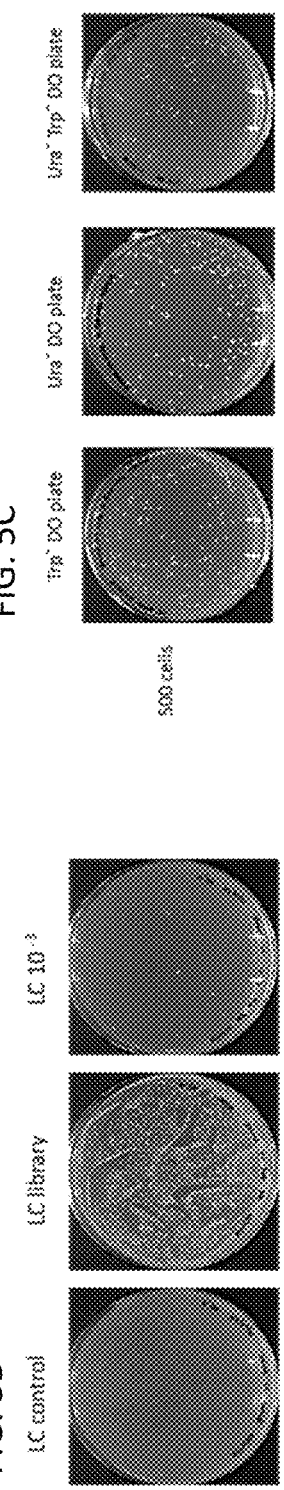

This corresponds to approximately $1.6 \times 10^9$ cells/ml and is sufficient for 2 electroporation reactions of 400 µl each. The cells were kept on ice until electroporation. 400 µl electro competent cells were gently mixed with required amount of plasmid DNA and transferred to a pre-chilled Bio-Rad GenePulser cuvette (0.2 cm electrode gap) and kept on ice for 5 min until electroporation. The cells were electroporated at 2.5 kV and 25 µF. Electroporated cells were transferred from each cuvette into 8 mL of 1:1 mix of 1 M sorbitol: YPD media, and incubated on a platform shaker at 220 rpm and 30° C. for 1 hour. Cells were collected by centrifugation and resuspended in SDCAA media. 10-fold serially diluted cells were prepare from the cell suspension and 100 µl of 10−3 and 10−4 diluted cells were plated onto selective plates (SDCAA plates) and incubated at 30° C. incubator for 3-4 days. Library size was determined from the colony counts after 3-4 days (FIG. 5A). After 3-4 days colonies were observed on SDCAA plate. Finally, 20% glycerol stock of the yeast ScFv antibody library was prepared by scrapping yeast cells and stored at −80° C.

Generation of Yeast Haploid Antibody Libraries for the Development of Fab Antibody Library Transformation was performed according to manufacturer's (Zymo Research) protocol with minor modifications. Briefly, EBY100ura3Δ4.03 strain (*S. cerevisiae* cells) and YVH10 were grown for overnight in 5 ml YPD media on a platform shaker at 220 rpm and 30° C. The OD600 value of overnight culture was checked and the overnight culture was re-inoculated into 50 ml YPD medium with starting OD600 ~0.4, until OD600 reached ~1.0-1.2 at 30° C., in incubator shaker with 220 rpm. Yeast cells were collected by centrifugation at 3000 rpm for 3 minutes and the media was removed. Cell pellet was washed with 10 ml EZ1 solution followed by centrifugation at 3000 rpm for 10 min. Then, cell pellet was resuspended in to 600 µl of EZ2 solution and further incubated at RT for 5 min. 200 µl of EZ2 solution containing competent yeast cells was mixed with appropriate amount of plasmid DNA and 500 µl of EZ3 solution. Above mix of competent yeast cells and DNA was incubated at 30° C. for 1 hr and 30 min. The yeast cells were centrifuged at 2400 rpm for 5 min. 200 µl of the supernatant was discarded and the cell pellet resuspended in the remaining supernatant.

10-fold serially diluted cells from the cell suspension was prepared and 100 µl of 10 −3 diluted cells was plated on selective plates and incubated at 30° C. incubator for 3-4 days. EBY100ura3Δ4.03 transformed with heavy chain antibody library was selected on tryptophan drop out glucose medium. However, YVH10 strain with light chain antibody library was selected on uracil drop out medium. Library size was determined from the colony counts after three days and estimated to be ~$10^5$. (FIG. 5A) 20% glycerol stock of the haploid yeast antibody libraries was prepared and stored at −80° C.

Generation of Diploid Yeast Fab Library Through Yeast Mating

The two haploid yeast strains with heavy and light chain libraries having different mating types were scraped with amino acid drop out glucose media. OD600 of the both haploid cell cultures was checked. About 1 OD600 of each culture was taken in 1.5 ml microfuge tube and spun at 13000 rpm for 3-5 min. Discard the supernatant then added 100 µL of purified water in each pellet and mix them together. Plated mixed yeast cultures onto YPD plate and incubated for 5-6 hrs at 30° C. Yeast cells from the YPD plate after 5-6 hrs were scraped and OD600 of the scraped yeast cells was monitored. The scraped culture were inoculated into ura trp double drop out glucose media with starting OD600 of 0.1 and incubated for at least 24 hrs at 30° C., 220 rpm (for diploid enrichment).

Figure 5C:
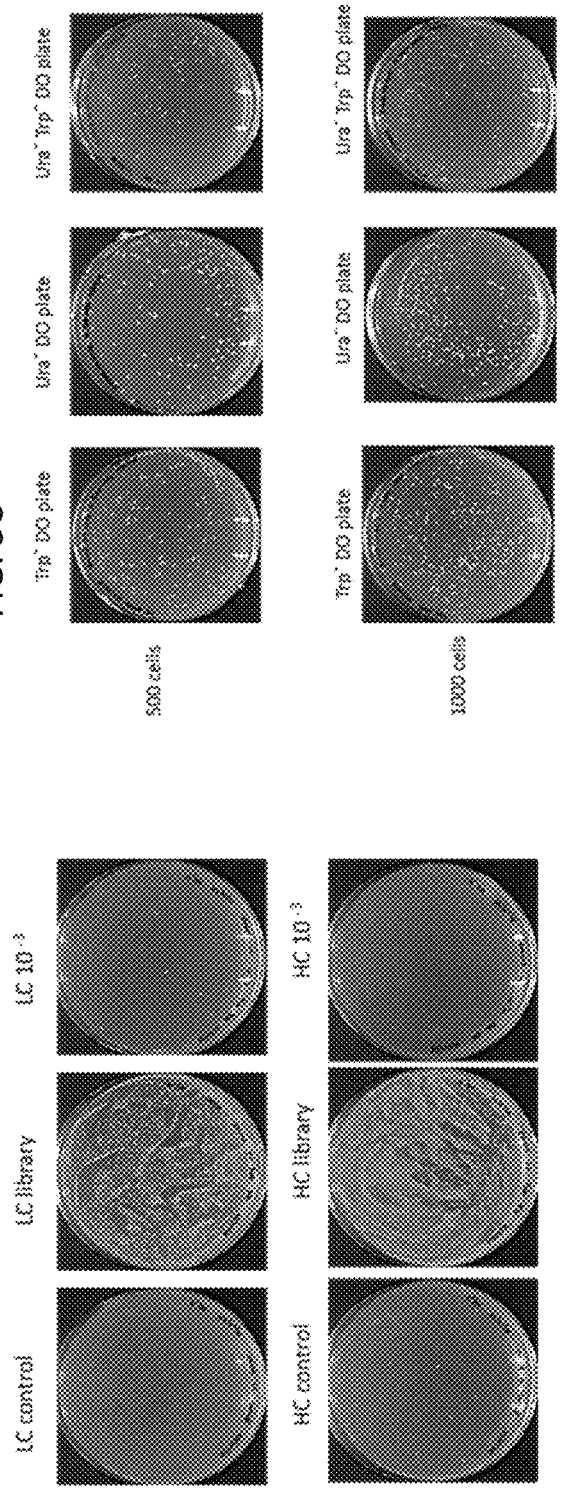

OD600 of enriched diploid culture was monitored and dilutions were prepared from enriched culture containing approximately 500 and 1000 cells. The dilutions were plated onto single and double drop out amino acid glucose agar plates and incubated at 30° C. for 2-3 days. Diploid library was selected on ura trp double drop out glucose plate. 20% glycerol stock of the remaining enriched diploid culture was prepared and stored at −80° C. Percentage mating efficiency was calculated as the number of diploid colonies grown in the double drop out media plates divided by the number of total colonies grown in the single drop out plates. Yeast fab antibody library was generated through yeast mating (FIG. 5C).

Flow Sorting of Yeast Fab and ScFv Library

Figure 5D:
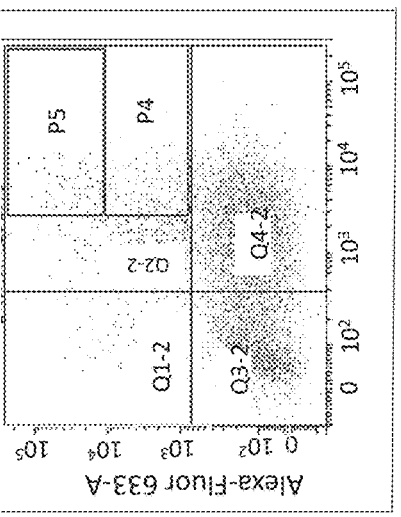
Figure 5D:
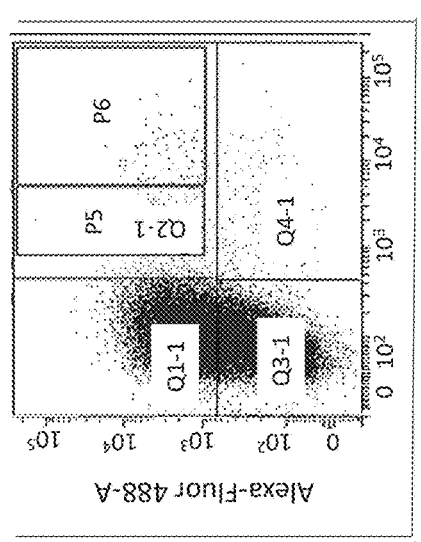
Figure 5D:
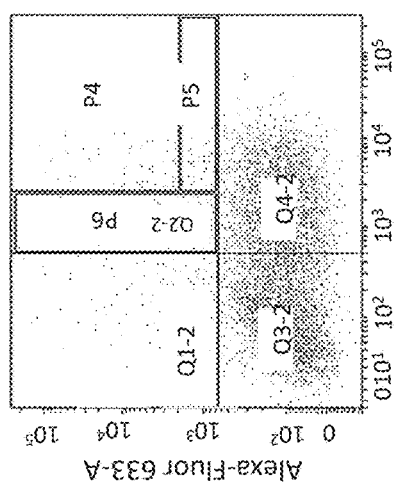
Figure 5D:
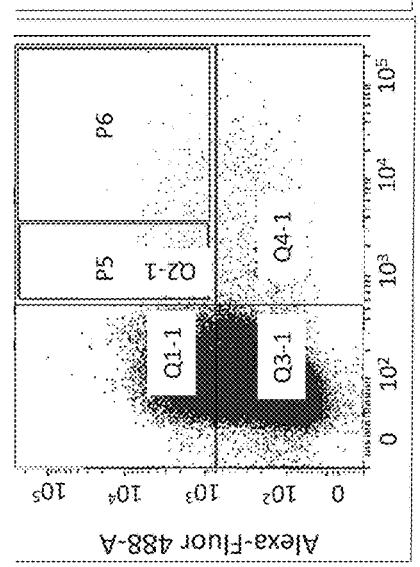
Figure 5D:
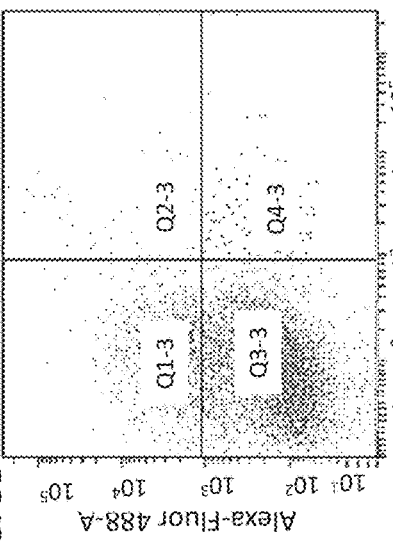
Figure 5E:
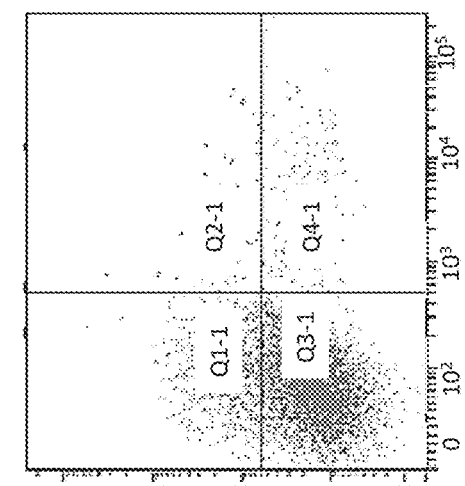

The yeast samples were inoculated into 3 ml of SDCAA media and incubated yeast cell for overnight at 30° C., 220 rpm. Next day, the OD600 value of the inoculated cultures was monitored by diluting of 1:10. 0.3 OD600 cells of the yeast samples was inoculated into 20 ml 2×SGCAA media and incubated for 48 hrs in incubator shaker at 20° C., at 220 rpm. The OD600 of the induced culture was monitored by diluting 1:10 after 48 hrs. About 0.1 OD600 cells was taken from grown yeast cultures into 1.5 ml tube and spun at 13,000 rpm for 2 minutes. The supernatant was discarded and the pellet was washed by adding 100 µl of 1×PBS and 241 pun at 13,000 rpm for 2 minutes. The supernatant was discarded again. 200 µl of primary antibody or biotinylated antigen with an appropriate concentration was added in yeast cell pellet and incubated for 45 min on rotation at RT. After incubation, the cells were spun at 13,000 rpm for 2 min and the supernatant was discarded. Cell pellet was washed twice by adding 200 µl of PBS containing 0.1% BSA and spun at 13,000 rpm for 2 minutes and the supernatant was discarded. 200 µl of secondary antibody with an appropriate concentration was added in to yeast cell pellet and incubated for 30 min on ice. After incubation, the cells were spun at 13,000 rpm for 2 minutes and the supernatant was discarded. The pellet was washed thrice by adding 200 µl of 1×PBS containing 0.1% BSA and spun at 13,000 rpm for 2 minutes. 300 µL of 1×PBS was added in yeast cell pellet and samples were analysed through flow sorter (FIGS. 5D and 5E). Concentrations for primary, secondary antibodies and biotinylated antigen are presented in Table 18.

TABLE 18

| Format of antibody library | Primary antibody (Concentration) | Secondary antibody (Concentration) |
|---|---|---|
| Expression of library | | |
| ScFv | Myc Tag polyclonal (5 µg/ml) | Goat anti-Chicken IgY (H + L) Secondary Antibody, Alexa Fluor 488 (5 µg/ml) |
| Fab | V5 Tag (5 µg/ml) | Goat anti-Chicken IgY (H + L) Secondary Antibody, Alexa Fluor 488 (5 µg/ml) |
| Binding of library | | |
| ScFv | Biotinylated CLEC2D antigen (250 nM for flow resort-1, 100 nM for flow sort-1, 50 nM for flow resort-2,) | Streptavidin, Alexa Fluor ™ 633 conjugate (5 µg/ml) |
| Fab | Biotinylated CLEC2D antigen (250 nM for flow resort-1, 100 nM for flow sort-1, 50 nM for flow resort-2,) | |

Figure 5F:
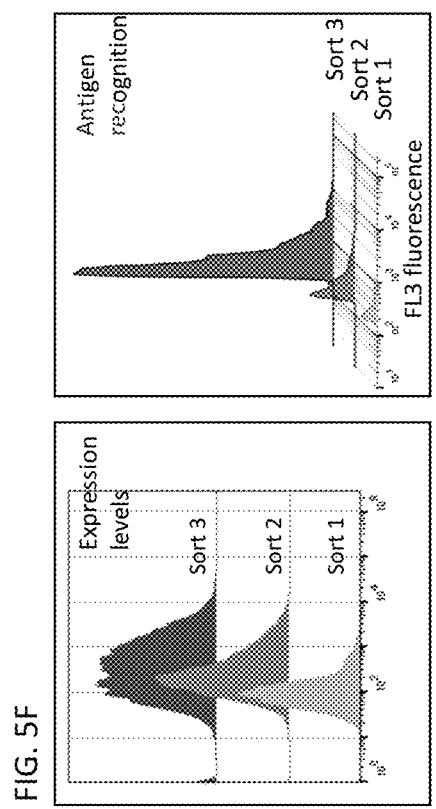
Figure 5G:
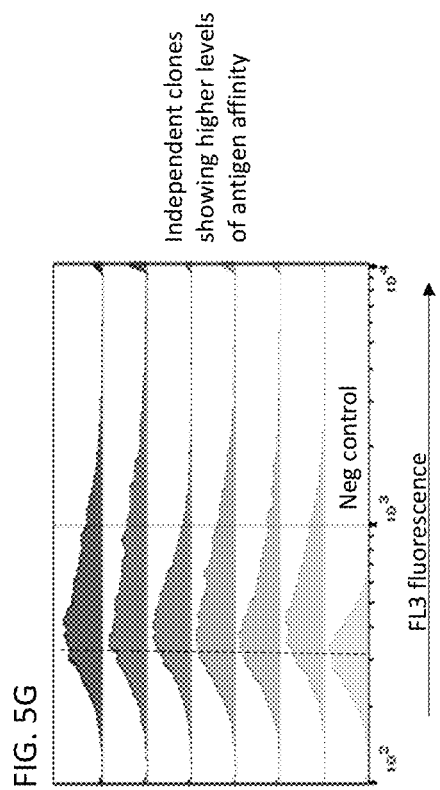
Figure 5H:
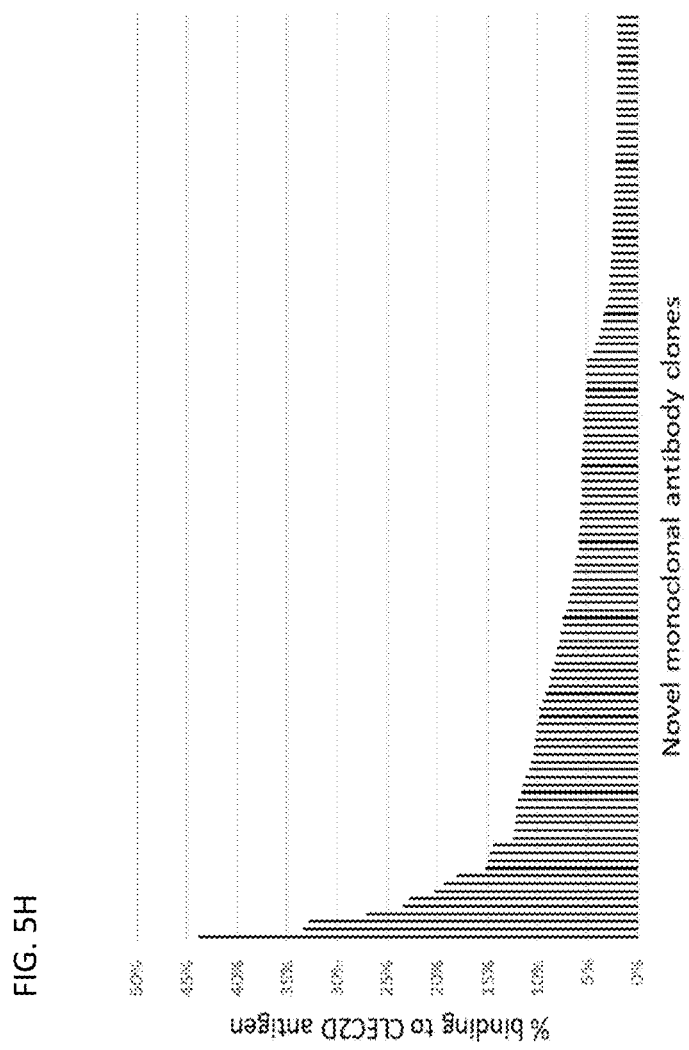
Figure 6B:
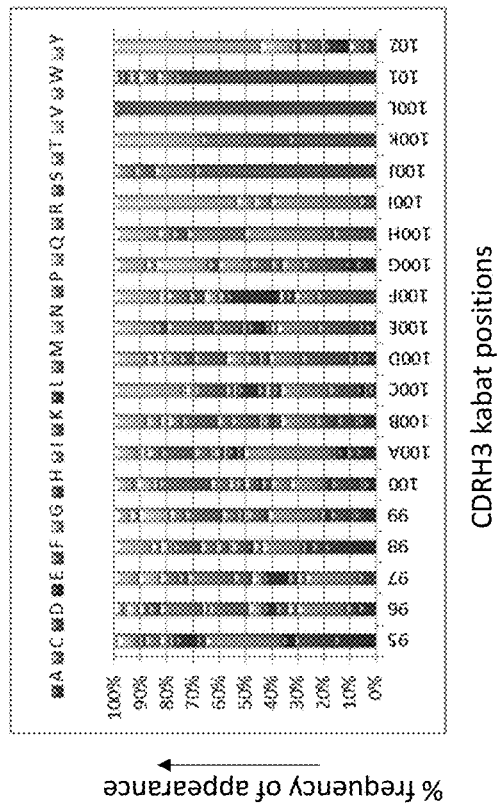
Figure 6A:
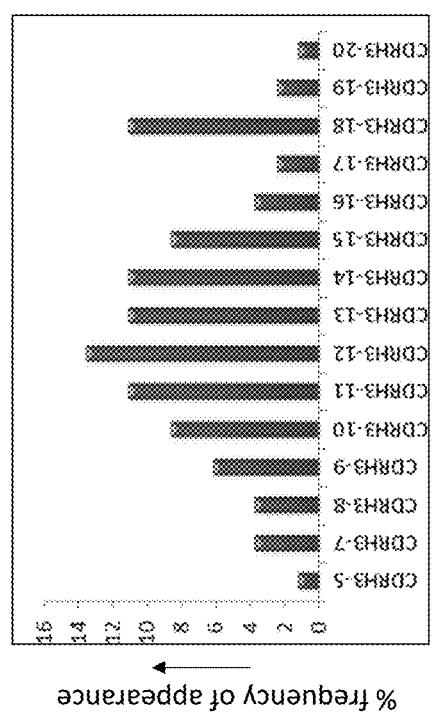
Figure 6D:
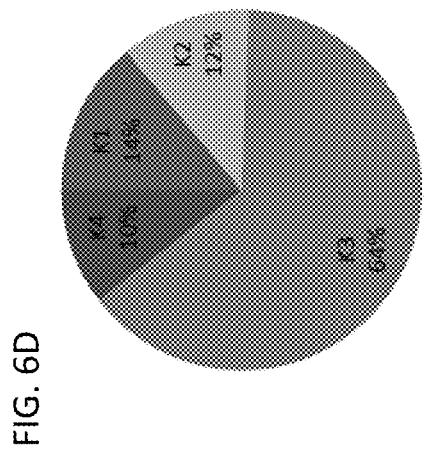
Figure 6C:
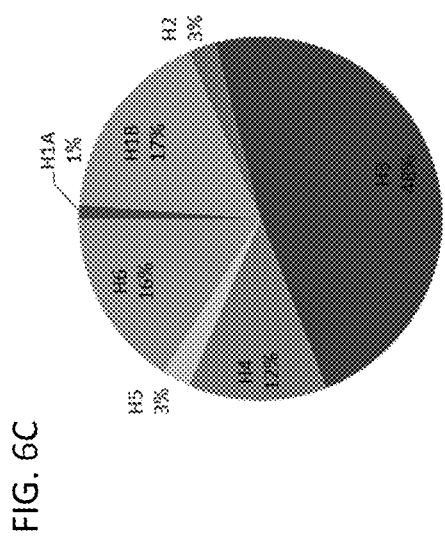

Individual Clone Screening from Sorted/Resorted ScFv or Sorted/Resorted Fab Pool Similar flow staining protocol was used as discussed during flow sorting for individual clone screening. About 1000 colonies were screened through flow cytometry for expression and antigen binding (FIGS. 5F, 5G, and 5H). These clones were selected on the basis of >2% and >5% positive for both binding and expression in case of Fab and ScFv clones respectively.

In addition selected pool of antibody genes as obtained from sorting against soluble CLEC2D antigen were subjected for next generation sequencing. This exercise was carried out for both ScFv and Fab format of antibody gene pools. As exemplified, Seq IDs SEQ ID 44; SEQ ID 45; SEQ ID 42; SEQ ID 1; SEQ ID 73; SEQ ID 21; SEQ ID 35; SEQ ID 58; SEQ ID 7; SEQ ID 260; SEQ ID 261; SEQ ID 258; SEQ ID 217; SEQ ID 289; SEQ ID 237; SEQ ID 251; SEQ ID 274; SEQ ID 223 were enriched at the final sorted round ranging from 2.5 fold to 7 fold, as applicable to clones screened in Fab format, while the clones screened in ScFv format were enriched to fold ranging from 2 fold to 106 fold, to an approximate. The fold enrichment estimation was carried out through number of gene copies seen at every round of sorting. This further supports the fact that antibodies against CLEC2D antigen were screened, isolated and identified via a robust platform comprising naïve antibody library screened phage and yeast display technologies.

Finally, individual yeast clones were identified using flow cytometry assays. Subsequently, peer group antibody gene sequencing was carried out and novel antibody sequences were taken for further cloning to mammalian gene expression vectors. Yeast plasmid DNA was isolated from selected yeast clones, existing in both Fab or ScFv formats, using Zymoprep Yeast Plasmid miniprep kit—The variable region of heavy and light chains in selected yeast clones with Fab format were amplified using vector specific primer followed by sequencing. While for clones in ScFv format, isolated plasmids from yeast colonies were subsequently transformed into NEB-alpha cells for larger production. The isolated plasmids from NEB-alpha cells were sent for sequencing confirmation. FIG. 5H summarizes percentage binding of monoclonal antibody clones with CLEC2D antigen, as determined by flow cytometry. The data suggest at least about 80% of the monoclonal antibody clones revealed detectably and specifically binding to CLEC2D antigen.

All sequence identifiers and relevant sequence identity analysis are described in Table 19, which lists antibody clones for variable heavy chains, and Table 20, which lists antibody clones for variable kappa light chains.

TABLE 19

SEQ ID NOs of VH Sequences of Anti-CLEC2D

| % Sequence Identity | Variable heavy chain Sequence ID NOs |
|---|---|
| 35%-40% | SEQ ID NO: 33; SEQ ID NO: 34; SEQ ID NO: 87; SEQ ID NO: 82; SEQ ID NO: 104 |
| 40%-45% | SEQ ID NO: 11; SEQ ID NO: 35; SEQ ID NO: 86; SEQ ID NO: 22; SEQ ID NO: 69; SEQ ID NO: 41; SEQ ID NO: 3; SEQ ID NO: 66; SEQ ID NO: 37; SEQ ID NO: 56; SEQ ID NO: 21; SEQ ID NO: 38; SEQ ID NO: 90; SEQ ID NO: 100; SEQ ID NO: 18; SEQ ID NO: 20; SEQ ID NO: 83; SEQ ID NO: 1; SEQ ID NO: 19 |
| 45%-50% | SEQ ID NO: 105; SEQ ID NO: 101; SEQ ID NO: 4; SEQ ID NO: 72; SEQ ID NO: 28; SEQ ID NO: 64; SEQ ID NO: 25; SEQ ID NO: 60; SEQ ID NO: 55; SEQ ID NO: 52; SEQ ID NO: 27; SEQ ID NO: 43; SEQ ID NO: 70; SEQ ID NO: 71; SEQ ID NO: 14; SEQ ID NO: 85; SEQ ID NO: 13; SEQ ID NO: 61; SEQ ID NO: 42; SEQ ID NO: 39; SEQ ID NO: 10; SEQ ID NO: 49; SEQ ID NO: 24; SEQ ID NO: 40; SEQ ID NO: 63; SEQ ID NO: 78; SEQ ID NO: 2; SEQ ID NO: 94; SEQ ID NO: 5 |
| 50%-55% | SEQ ID NO: 97; SEQ ID NO: 16; SEQ ID NO: 76; SEQ ID NO: 9; SEQ ID NO: 89; SEQ ID NO: 107; SEQ ID NO: 68; SEQ ID NO: 29; SEQ ID NO: 67; SEQ ID NO: 74; SEQ ID NO: 32; SEQ ID NO: 81; SEQ ID NO: 106; SEQ ID NO: 31; SEQ ID NO: 62; SEQ ID NO: 48; SEQ ID NO: 75; SEQ ID NO: 12; SEQ ID NO: 102; SEQ ID NO: 54; SEQ ID NO: 80; SEQ ID NO: 26; SEQ ID NO: 30; SEQ ID NO: 92; SEQ ID NO: 108; SEQ ID NO: 79 |
| 55%-60% | SEQ ID NO: 45; SEQ ID NO: 15; SEQ ID NO: 51; SEQ ID NO: 44; SEQ ID NO: 73; SEQ ID NO: 36; SEQ ID NO: 77; SEQ ID NO: 50; SEQ ID NO: 6 |
| 60%-80% | SEQ ID NO: 9; SEQ ID NO: 53; SEQ ID NO: 95; SEQ ID NO: 23; SEQ ID NO: 103; SEQ ID NO: 7 |
| 80%-90% | SEQ ID NO: 57; SEQ ID NO: 91; SEQ ID NO: 98; SEQ ID NO: 84; SEQ ID NO: 58; SEQ ID NO: 88; SEQ ID NO: 96; SEQ ID NO: 47; SEQ ID NO: 17; SEQ ID NO: 8 |
| 90%-99% | SEQ ID NO: 46; SEQ ID NO: 65; SEQ ID NO: 59; SEQ ID NO: 99 |

TABLE 20

SEQ ID NOs of VL Sequences of Anti-CLEC2D

| % Sequence Identity | Variable kappa light chain Sequence IDs |
|---|---|
| 50%-60% | SEQ ID NO: 282; SEQ ID NO: 308; SEQ ID NO: 287; SEQ ID NO: 321; SEQ ID NO: 236; SEQ ID NO: 265; SEQ ID NO: 270; SEQ ID NO: 275; SEQ ID NO: 306; SEQ ID NO: 296; SEQ ID NO: 241; SEQ ID NO: 314; SEQ ID NO: 223 |
| 60%-65% | SEQ ID NO: 254; SEQ ID NO: 289; SEQ ID NO: 238; SEQ ID NO: 268; SEQ ID NO: 248; SEQ ID NO: 284; SEQ ID NO: 244; SEQ ID NO: 310; SEQ ID NO: 243; SEQ ID NO: 285; SEQ ID NO: 220; SEQ ID NO: 255; SEQ ID NO: 293; SEQ ID NO: 298; SEQ ID NO: 235; SEQ ID NO: 319; SEQ ID NO: 245; SEQ ID NO: 224; SEQ ID NO: 291; SEQ ID NO: 277; SEQ ID NO: 232 |
| 65%-70% | SEQ ID NO: 307; SEQ ID NO: 262; SEQ ID NO: 253; SEQ ID NO: 276; SEQ ID NO: 323; SEQ ID NO: 234; SEQ ID NO: 261; SEQ ID NO: 312; SEQ ID NO: 290 |
| 70%-75% | SEQ ID NO: 259; SEQ ID NO: 239; SEQ ID NO: 281; SEQ ID NO: 228; SEQ ID NO: 217; SEQ ID NO: 227; SEQ ID NO: 251 |
| 75%-80% | SEQ ID NO: 231; SEQ ID NO: 250; SEQ ID NO: 260; SEQ ID NO: 226; SEQ ID NO: 271; SEQ ID NO: 256; SEQ ID NO: 272; SEQ ID NO: 278; |

TABLE 20-continued

SEQ ID NOs of VL Sequences of Anti-CLEC2D

| % Sequence Identity | Variable kappa light chain Sequence IDs |
|---|---|
| 80%-85% | SEQ ID NO: 302; SEQ ID NO: 320; SEQ ID NO: 295; SEQ ID NO: 292; SEQ ID NO: 229; SEQ ID NO: 264; SEQ ID NO: 252; SEQ ID NO: 267; SEQ ID NO: 304; SEQ ID NO: 300; SEQ ID NO: 311; SEQ ID NO: 324 SEQ ID NO: 222; SEQ ID NO: 258; SEQ ID NO: 219; SEQ ID NO: 313; SEQ ID NO: 294; SEQ ID NO: 303; SEQ ID NO: 317; SEQ ID NO: 273; SEQ ID NO: 266; SEQ ID NO: 315; SEQ ID NO: 257; SEQ ID NO: 288; SEQ ID NO: 301; SEQ ID NO: 221; SEQ ID NO: 240; SEQ ID NO: 299; SEQ ID NO: 247; SEQ ID NO: 263; SEQ ID NO: 274 |
| 85%-99% | SEQ ID NO: 218; SEQ ID NO: 249; SEQ ID NO: 230; SEQ ID NO: 279; SEQ ID NO: 316; SEQ ID NO: 237; SEQ ID NO: 322; SEQ ID NO: 225; SEQ ID NO: 318; SEQ ID NO: 233; SEQ ID NO: 305; SEQ ID NO: 280; SEQ ID NO: 283; SEQ ID NO: 242; SEQ ID NO: 286; SEQ ID NO: 297; SEQ ID NO: 309; SEQ ID NO: 246 |

Example 3: Antibody Sequence Analysis to Identify Novel Antibody Clones

Variable regions of isolated antibodies for both heavy and light chains that specifically bind the CLEC2D antigen comprise of six hyper variable regions: 3 hyper variable regions from light chain (CDRL1, CDRL2, and CDRL3) and 3 hyper variable regions from heavy chain (CDRH1, CDRH2, and CDRH3). The length of the hypervariable regions may vary significantly, as shown for CDRH3, whose lengths have significant representation in the pool, ranging from 4-23 amino acids. The amino acid compositions were measured at every heavy chain CDRH3 length to understand the sequence variability of selected antibody genes against CLEC2D (FIGS. 6A, 6B, 6C, and 6D).The antibody sequences were analysed to determine uniqueness. Multiple sequence alignment tools were used to compare the antibody gene sequences with published antibody sequences in databases like IMGT, IgBLAST etc.

Further analysis of selected sequences identified antibody genes with de-amidation motifs, isomerization motifs, proteolytic cleavage motifs, N-linked glycosylation sites, plastic binding motifs, streptavidin binding motifs, human Fc binding motifs, mouse IgM binding motifs, bovine IgG motifs, proline rich motifs and cysteine rich motifs, etc. Such antibody genes were not deemed suitable for therapeutic monoclonal antibody development and therefore were not considered for further evaluation. Based on the extend of binding observed for antibody genes against soluble CLEC2D antigen at the level of individual yeast colony screening, top 40 binders, not limited to, were of further interest towards subsequent development. Only confirmed antibody gene sequences were taken for further cloning, expression and characterization.

Example 4: Cloning of Novel Antibody Genes

Error free antibody variable heavy and variable light chain regions were subsequently cloned into mammalian expression vectors, having various isotype backbones, either wildtype or mutants, originated from human, mouse and cynomolgus monkey species. Table 21 below summarizes relevants vectors developed towards cloning of identified anti-CLEC2D antibody genes and deposited to Microbial Type Culture Collection and Gene Bank (MTCC), India.

TABLE 21

| S. No. | Taxonomic Designation | Identification Reference | MTCC Number Assigned |
|---|---|---|---|
| 1 | E.coli | pZB005 | MTCC 25356 |
| 2 | E.coli | pZB006 | MTCC 25357 |
| 3 | E.coli | pZB007 | MTCC 25358 |
| 4 | E.coli | pZB008 | MTCC 25359 |
| 5 | E.coli | pZB009 | MTCC 25360 |
| 6 | E.coli | pZB010 | MTCC 25361 |
| 7 | E.coli | pZB011 | MTCC 25362 |
| 8 | E.coli | pZB012 | MTCC 25363 |
| 9 | E.coli | pZB013 | MTCC 25364 |
| 10 | E.coli | pZB014 | MTCC 25365 |

Figure 7B:
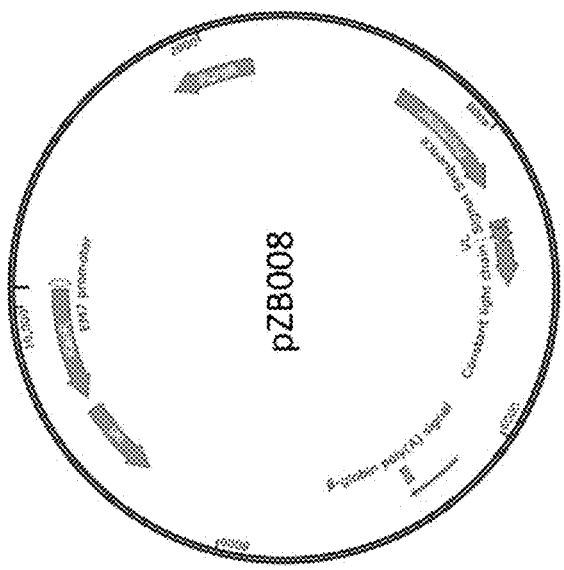
Figure 7A:
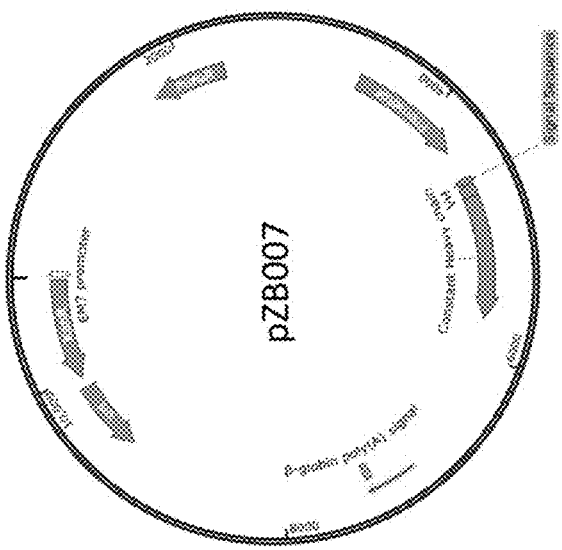

As exemplified by, the mammalian expression vectors pZB007 (MTCC 25358) & pZB008 (MTCC 25359) were designated and used for variable heavy chain and light chain gene cloning, respectively (FIGS. 7A and 7B). The vectors were custom designed and synthesized for the expression of antibody genes under the control of suitable promoter sequences. The plasmids carry a kanamycinR/puromycinR cassette driven by strong promoter and high-copy-number ColE1/pMB1/pBR322/pUC origin of replication for propagation (FIGS. 7A and 7B).

Sequence confirmed selected plasmids, as screened through phage and yeast display platform, against soluble CLEC2D antigen, using human naïve antibody library, were used as template for subsequent PCR amplification. PCR reactions were performed using sequence specific primers to amplify the selected clones having variable heavy and light chain regions. PCR reactions was carried out on an Eppendorf™ Mastercycler™ pro PCR System in 50 µL mixture volume consisting of 0.2 µM of each primer (Eurofins, India), 200 units of Phusion polymerase (NEB). Following an initial denaturation at 94° C. for 3 min, 30 cycles of 30 seconds denaturation at 94° C., and 50 seconds annealing at 60° C., 10 seconds primer extension at 72° C., 10 minutes final extension at 72° C. were performed. The PCR amplified product was extracted using QIAquick Gel Extraction kit. The plasmid vector pZB007 was linearized through restriction enzyme digestion by AscI and XbaI and for pZB008 with EcoRI and AscI. The inserts fragment and linearized vector were gel extracted using QIAGEN kit (20021).These purified vector and insert were used for recombination using Infusion HD Cloning kit (Takara, USA). Transformation of infusion reaction mixture into bacterial cells were performed. 100 µL aliquot of competent E. coli cells (Stellar) were taken from −80° C. freezer, thawed on ice for 5 minutes. 50% of recombination sample were added to the competent cells and gently mixed, incubated on ice for 20 minutes. Heat shock was given at 42° C. for 50 seconds in a dry bath. The vials were quick chilled on ice for 2 minutes. 0.950 mL of LB broth pre-warmed at 37° C. was added and incubated at 37° C., 220 rpm for 1 hour, in shaker incubator. 100 µL of the resulting culture was plated on LB agar media with kanamycin and incubated for overnight at 37° C.

Transformants containing specific DNA plasmid were inoculated in 5 mL of LB broth with Kanamycin and were incubated at 220 rpm, at 37° C. for overnight. Plasmid DNA was isolated from overnight grown culture using QIAGEN kit. Isolated clones were screened through restriction enzyme analysis performed using SpeI and XhoI enzymes and confirmed through sequencing and found to be error free. Sequence confirmed plasmid DNA from confirmed clones were purified at large scale using QIAprep Spin Midiprep kit (Qiagen) and in order to be used for subsequent transfection experimentation.

Example 5: Preparation of Anti-CLEC2D Antibody and Selection of CHO Expressed Novel Monoclonal Antibodies Strategy to Select Novel Monoclonal Antibody Clones Owing to riveting design and properties of therapeutic antibody, it is required to be rational towards selecting a specific monoclonal antibody for further development. Moreover, generation, manufacturing and storage of antibodies are continuing to pose challenges as molecule properties such as pharmacokinetics, solubility, expression, viscosity and long-term stability are difficult to predict and understanding inter-parameter relationship is rather limited. Moreover considering the selected/identified diverse antibody genes which funnelled through antibody display platforms needed to be arranged through the ranking protocol. A comprehensive scoring function/methods was employed/developed based on existing sequencing data, exemplified by uniqueness, presence of certain motifs which could be not beneficial for further selection/development of clones; affinity towards CLEC2D antigen either in soluble form or as membrane bound format, and functionality; titre, yield, recovery, analytical profile, amongst others, either as independent or in combination, thereof.

The clones would go through multiple rounds of checks on salient parameters in due course of development having a dynamic selection system which will effectively be employed towards selection of final clones.

CHO Cell Transfection with Full Length CLEC2D Gene for Cell Surface Expression.

Figure 8A:
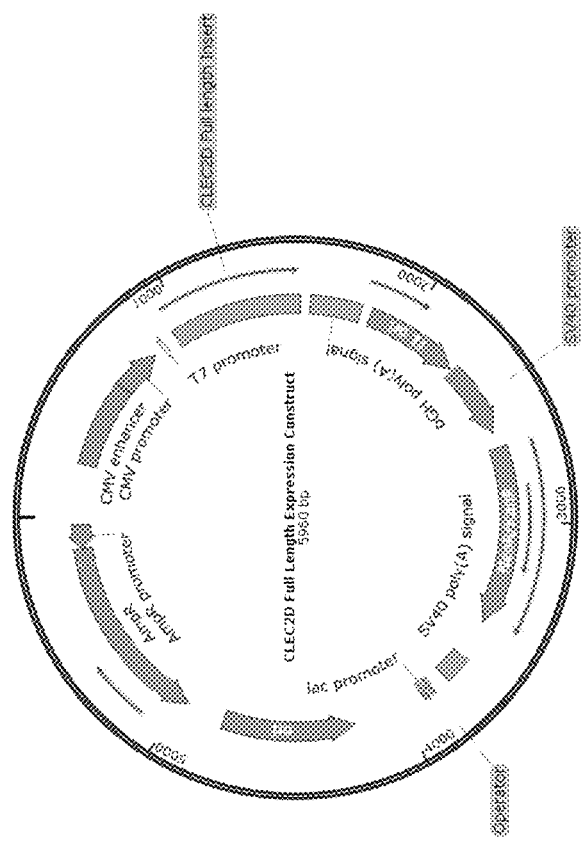

In order to estimate the binding propensity of novel antibody genes identified against CLEC2D protein expressed on cell surface, a full length CLEC2D construct was synthesized. Native signal sequence was used for efficient surface expression on CHO cells. The full length CLEC2D gene sequence was cloned into the pCDNA3.1 mammalian expression vector (FIG. 8A). Subsequently the construct was transformed into neb-alpha and isolated in large quantity using Qiagen midi prep kit. CHO suspension cells with >90% viability were transfected with a full-length CLEC2D gene expression plasmid. As exemplified, for 10 ml volume of transfection $1.25 \times 10^6$ cells/ml were taken, wherein CHO cells were centrifuged at 1000-1400 rpm for 4-5 minutes. The spent media was decanted, and the cells were re-suspended in 2.5 ml of OptiMEM I media. DNA constructs were transfected using Lipofectamine LTX with Plus' reagent. 5-10 of DNA was used with 1:3 to 1:6 DNA to transfection reagent ratio and 5-10 µl Plus™ reagent was used. DNA and Lipofectamine LTX complex was prepared in 2.5 ml OptiMEM I and incubated at 20-25° C. for 5 minutes for complex formation. The transfection mix was added slowly to the cell suspension. The cells were incubated for 4-6 hours at 37° C. in a 5% $CO_2$ shaker incubator at 100-120 RPM. 5 ml of Power CHO2 CD growth media was added to the cells. The cells were incubated at 37° C. in a 5% $CO_2$ shaker incubator at 100-120 RPM. 2-4 days post transfection 2 ml Power CHO2 CD growth media was added and Glutamax was added from 200 mM stock to achieve a final concentration of 2 mM. The cells were incubated at 37° C. in a 5% CO2 shaker incubator at 100-120 RPM. Cells were analyzed for surface antigen binding by flow-cytometry on day 3, day 4 and day 5 after transfection. Transfected CHO cells with full length constructs will be known here onwards as C4548, unless mentioned otherwise elsewhere.

Figure 8B:
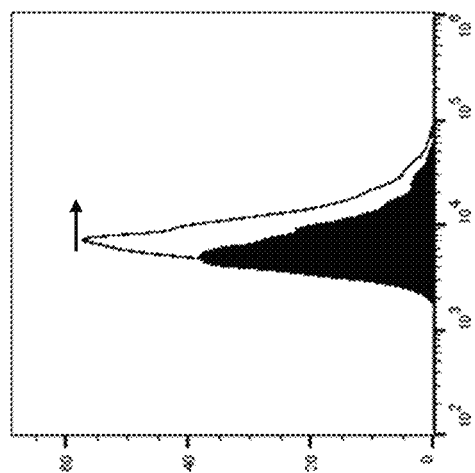

C4548 cells, transiently expressing full-length membrane anchored CLEC2D antigen were validated through both flow cytometry and confocal microscopy by using commercial anti-CLEC2D antibody. Approximately, 50,000-100,000 cells were taken in a 96-well U bottom plate. 1-5 µg of commercial anti-CLEC2D Antibody (4C7) (Cat #H00029121-M01; Novus Biologicals) in 100 µl assay buffer was added to the both untransfected CHO and C4548 transfected with full length CLEC2D surface antigen construct and incubated for 1 hr at room temperature in DPBS with 1-2% BSA. After 1 hr incubation, the plate was centrifuged at 1000-1400 rpm for 3-5 minutes. The cells were further washed twice with 200 µl of 0.1% BSA solution. 1 in 100 dilution of secondary antibody i.e., anti-mouse Alexa 488 (Thermo Fisher Scientific) was added. Subsequently, the plates were incubated at room temperature for 30 minutes in dark. The wells were washed twice with 0.1% BSA solution and analyzed by flow cytometry. Cell surface binding of the monoclonal antibody was estimated by comparing increase in fluorescence signal between CLEC2D expressing CHO cells and un-transfected CHO cells. Surface expression of CLEC2D antigen was optimum on day 4 to day 5 on C4548 transfected CHO cells (FIG. 8B).

For confocal microscopy experimentation, 250 µl of 12 µg/ml Poly D Lysine was added per well and incubated overnight at 37° C. Chambers were washed twice with 500 µl of DPBS and stored in 2° C. to 8° C. Un-transfected and CLEC2D antigen expressing CHO cells, C4548, were used, wherein cell count and viability data was collected using vi-cell Beckman coulter. 50,000 cells were seeded in 500 µl growth media (Power CHO2 with 4 mM Glutamine+1% Penstrep) with 10% FBS per well. All the cells were incubated in humidified 5% CO2 incubator at 37° C. for 2 days prior to the experiment. Further, cells were washed with 1×PBS then fixed in 2% formaldehyde in PBS for 5 minutes at room temperature (RT). Cells were then rinsed twice with 1×PBS followed by blocking with 5% BSA for 1 hr at RT. After 1 hour incubated with diluted primary antibody i.e., anti-CLEC2D Antibody (4C7) (2 µg) for 1 hour at RT followed by washing for at least three times in PBS and then incubated with the anti-mouse Alexa 488 (Thermo Fisher Scientific), secondary antibody, (2 µg) for 1 hour at RT. Cell nuclei were stained using DAPI (1:1000 for 5 min at RT). Cells were then rinsed thrice in 1×PBS and remained submerged in PBS until imaging. Immunofluorescence microscopy was performed on Olympus FV3000-4 laser scanning confocal microscope with a 60× magnification with 1.35-NA objective. Cells were imaged at 16 hrs after treatment by using appropriate wavelengths (For DAPI, λex 405 nm and λem 430-470 nm; for Alexa 488, λex 488 nm and λem 510-530 nm. Images were analyzed with Fiji ImageJ software.

Figure 8C:
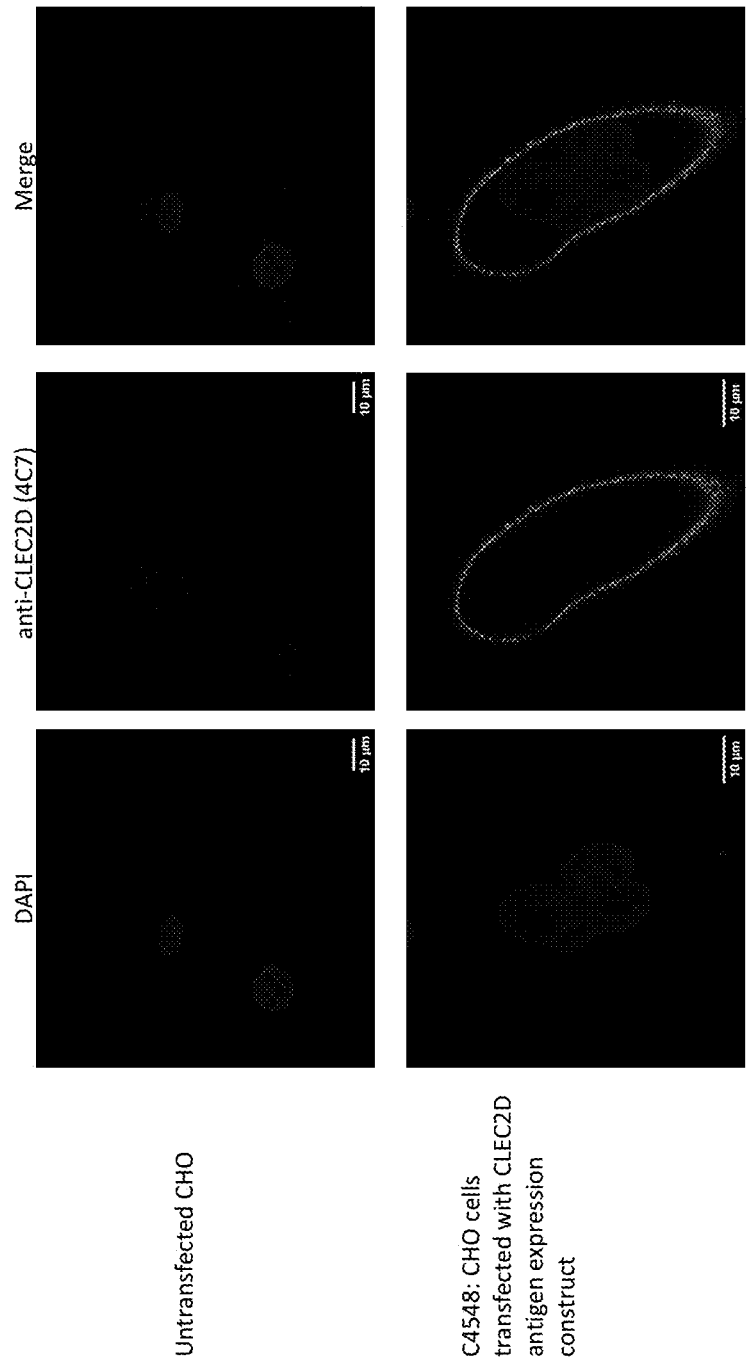

As confirmed by microscopy images, the surface expression of CLEC2D on C4548 cells, were observed as distributed on cell surface while untransfected CHO cells fails to provide any anti-CLEC2D antibody dependent signal under microscopy (FIG. 8C).

CHO Cell Transfection to Express Novel Anti-CLEC2D Monoclonal Antibody Clones

Antibody heavy chain and light chain genes were expressed using mammalian gene expression vectors with appropriate signal sequences for secretion of correctly folded monoclonal antibodies into culture media. CHO suspension cells at more than 90% viability were transfected for antibody gene expression. CHO cells, at $1.25 \times 10^6$ cells/ml, were centrifuged at 1000-1400 rpm for 4-5 minutes. The spent media was decanted. The cells were re-suspended in 25 ml of OptiMEM I media. Antibody heavy chain and light chain gene expressing plasmids were co-transfected at various stoichiometry (such as, 1:2, 1:3, 1:4, 2:3, 3:1, 4:1 etc.) using Lipofectamine LTX with Plus™ reagent. 50-100 pg of DNA was used with 1:3 to 1:6 DNA to transfection reagent ratio and 50-100 μl Plus™ reagent. DNA and Lipofectamine LTX complex was prepared in 25 ml OptiMEM I and incubated at 20-25° C. for 5 minutes for complex formation. The transfection mix was added slowly to the cell suspension. The cells were incubated for 4-6 hours at 37° C. in a 5% $CO_2$ shaker incubator at 100-120 RPM. 50 ml of Power CHO2 CD growth media was added to the cells. The cells were incubated at 37° C. in a 5% $CO_2$ shaker incubator at 100-120 RPM. 2-4 days post transfection 20 ml Power CHO2 CD growth media was added, and Glutamax was added from 200 mM stock to achieve final concentration of 2 mM. The cells were incubated at 37° C. in a 5% $CO_2$ shaker incubator at 100-120 RPM. Day 6 post transfection, cell culture supernatant (50 mL) was harvested by centrifugation at 1400-2000 rpm for 10-15 minutes.

Screening of CHO expressed monoclonal antibodies using cell surface binding: transient Subsequently, harvested culture supernatant of 50 mL containing secreted novel anti-CLEC2D antibody clones were subjected to purification by Protein A affinity chromatography using cellgravity columns containing Mabselect SuRe resin (GE Healthcare). The method starts with Protein A column sanitization step wherein 3 Column Volume (CV) of 0.5M Sodium Hydroxide (NaOH) solution was passed at RT for 5 minutes followed by 8 Column Volume of Purified water. Subsequently, Protein A column was equilibrated with 3 CV of Protein A equilibration buffer comprises of 30 mM Sodium phosphate, 120 mM NaCl pH 7.0±0.2. 50 mL culture supernatant was loaded on equilibrated Protein A column while flow through was reloaded. This procedure was repeated twice. 3 CV of Protein A equilibration buffer washing was carried out followed by 3 CV of Protein A high salt buffer (30 mM Sodium phosphate, 1M NaCl pH 7.0±0.2) wash.

Further 3 CV of Protein A equilibration buffer was passed through the column followed by 4 CV of Protein A low pH buffer (30 mM Sodium phosphate, 50 mM NaCl pH 6.0±0.2) wash. Next, 5 CV of Protein A elution buffer (30 mM Sodium phosphate, 50 mM NaCl pH 3.0±0.1) was employed in order to elute the bound monoclonal anti-CLEC2D antibody. Further, Protein-A elute, containing antibody, was neutralized to pH ~7.0 by adding appropriate amount of 1M Tris solution.

Figure 9A:
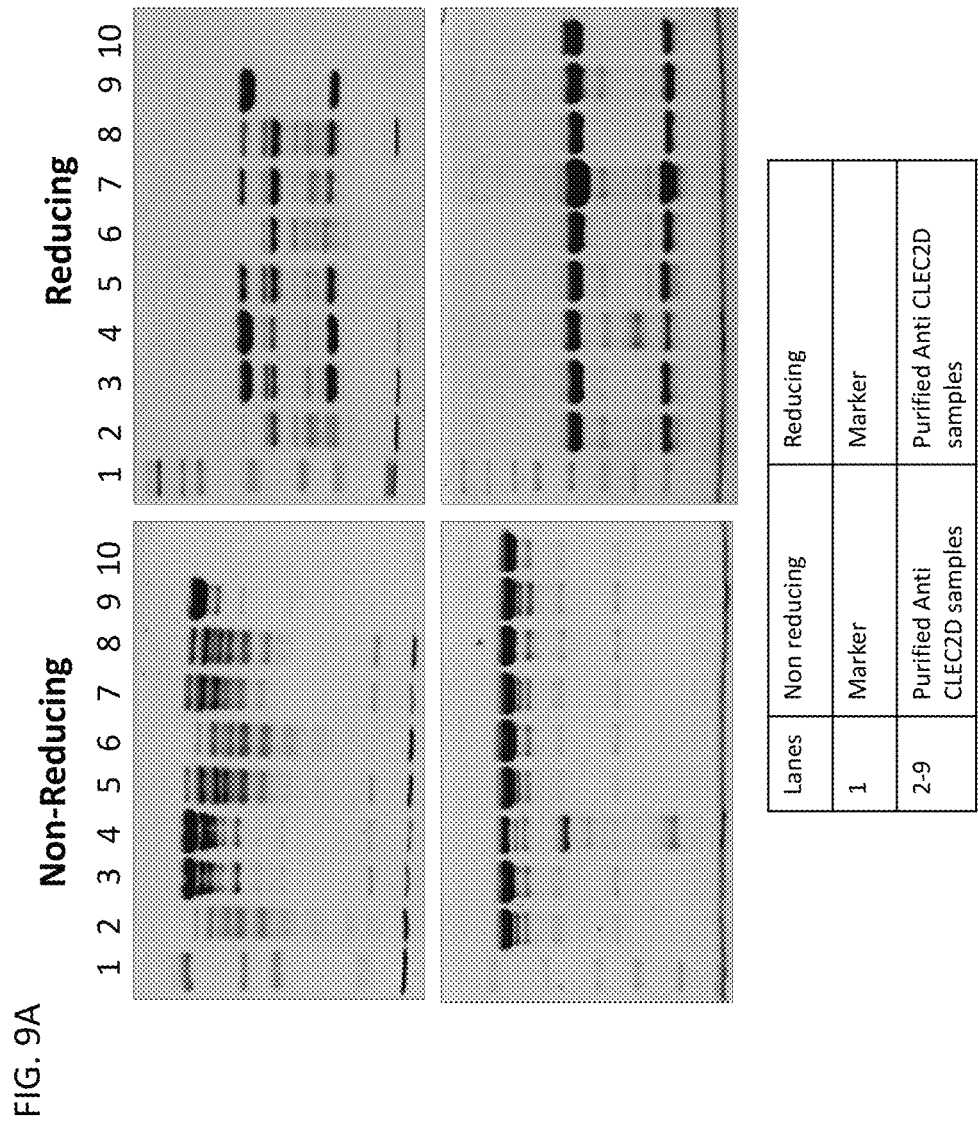

Following neutralization, Protein-A elute was concentrated and buffer exchanged into 1×PBS using Amicon 30 kDa cut-off concentrator. Protein sample was recovered from concentrator and concentration was measured by A280 using Nanodrop Biophotometer. Proteins were analysed by SDS-PAGE as shown in FIG. 9A, under reducing and non-reducing condition. Subsequently, these protein samples were used for further experimentation.

As judged by quantitation, clones with product yield higher than 100 μg were shortlisted for the SDS-PAGE analysis to check the product quality under reducing and non-reducing conditions. Successively, clones with prominent bands in SDS-PAGE gels, as explained by, appearance of ~150 kDa under non-reducing condition and ~50 kDa (representing heavy chain) and ~25 kDa (representing Light chain) under reducing condition were shortlisted for further analysis (FIG. 9A). In addition, purity was also judged through number of bands appeared along with the target protein and were also considered as criteria for selecting/shortlisting the clones. Proteins with more than 3 bands under non-reducing conditions similarly proteins with more than 1 band for heavy chain or light chain under reducing conditions were not taken into consideration.

Cell Surface Binding Assay: Through Flow Cytometry and Confocal Microscopy

CHO suspension cells transiently expressing full-length membrane anchored CLEC2D antigen were used to screen antibody samples (cell culture supernatant and/or purified protein). 50,000-100,000 cells were taken in a 96-well U bottom plate. 100 μl of cell culture supernatant or 0.03-3 μg of purified antibody in 100 μl assay buffer was added to the CLEC2D expressing cells and incubated for 1 hr at room temperature in DPBS with 1-2% BSA. After 1 hr incubation, the plate was centrifuged at 1000-1400 rpm for 3-5 minutes. The cells were further washed twice with 200 μl of 0.1% BSA solution. 1 in 100 dilution of secondary antibody—goat anti human IgG FITC was added. Subsequently, the plates were incubated at room temperature for 30 minutes in dark. The wells were washed twice with 0.1% BSA solution and analyzed by flow cytometry. Commercially available anti-CLEC2D monoclonal Ab (Novus Biologicals) was used as a positive control and anti-mouse Alexa 488 (Thermo Fisher Scientific) was used as the secondary antibody. Cell surface binding of the monoclonal antibody was estimated by comparing increase in fluorescence signal between CLEC2D expressing CHO cells and un-transfected CHO cells.

In order to screen identified novel anti-CLEC2D monoclonal antibody, validated C4548 cells and PC3 cells were subjected for monitoring CLEC2D antigen binding through both flow cytometry and confocal microscopy. Prior to experimentation, cell count was taken by Vi-cell XR automated cell counter. Method of sample preparation for flow cytometry was as described above while ~1-5 μg of purified Anti-CLEC2D antibody clones and reference positive control, respectively, to estimate the membrane bound CLEC2D binding on Untransfected CHO cells and C4548 cells. Cells were centrifuged at 1400-1500 rpm for 4-5 minutes. The pellet was re-suspended in 1 ml DPBS. 50,000 cells were aliquoted in each well of a 96 well plate. Both test samples and reference control was added to each well and incubated for 30-60 minutes at room temperature (25° C.). The plate was centrifuged at 1400-1500 rpm for 4-5 minutes, the supernatant was aspirated and cells were washed with 0.1% BSA in DPBS. 2.5 ml of 2% BSA was diluted to 50 ml with DPBS. Goat anti human IgG FITC conjugate was used as secondary antibody. 1:100 dilution of secondary antibody was prepared in DPBS and 100 μl was added to each well.

Figure 9B:
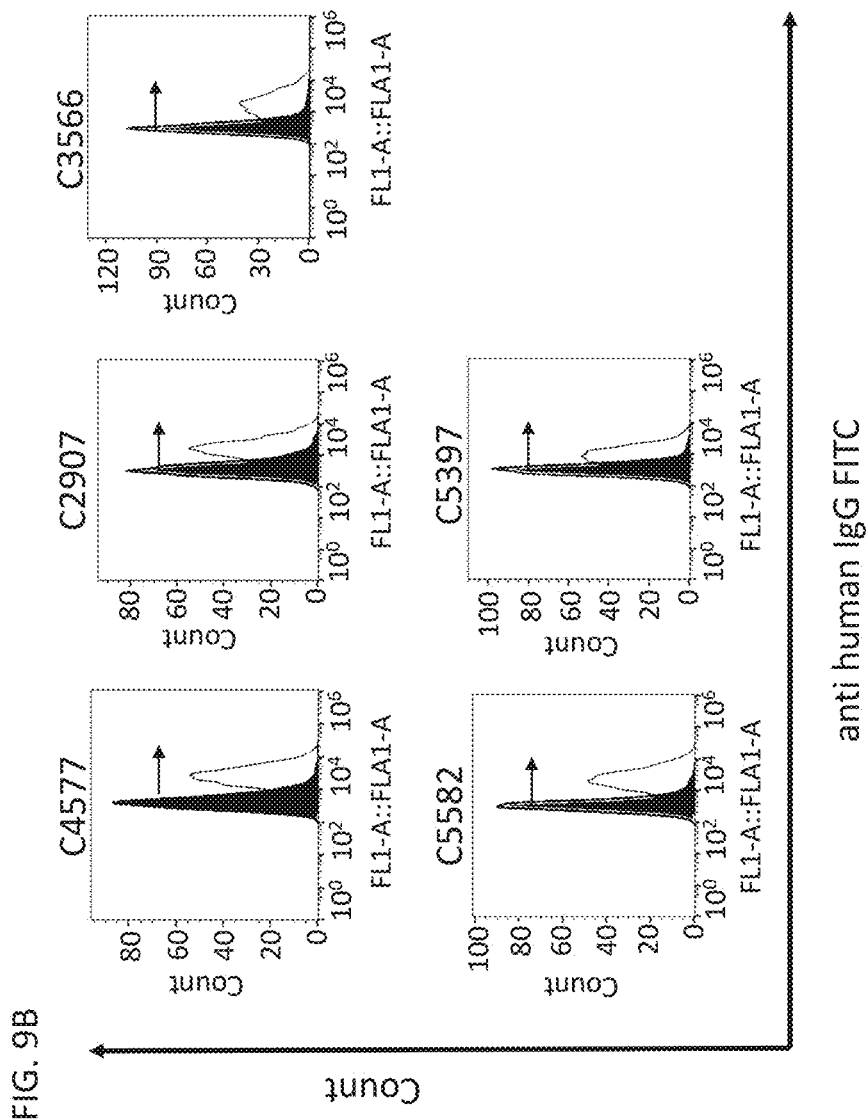

The plate was incubated for 30 minutes at room temperature (25° C.) in dark. The cells were washed with 0.1% BSA and re-suspended in 100 μl of 1% BSA. Samples were analyzed by flow-cytometry (FIG. 9B).

Binding of test sample supernatant on un-transfected CHO cells was estimated and used for calculation of specific binding on C4548 cell surface using following formula:

$$\text{Fold change in } MFI = \frac{\text{Median } FITC\text{-}A \text{ of test sample on } CHO \text{ cells}}{\text{Median } FITC\text{-}A \text{ of test sample on } C4548 \text{ cells}}$$

For microscopy experimentation, PC3 cells were seeded, wherein, 250 μl of 12 μg/ml Poly D Lysine was added per well and incubated overnight at 37° C. Chambers were washed twice with 500 μl of DPBS and stored in 2° C. to 8° C. Adherent cell lines such as PC3, were trypsinized using 0.05% trypsin. Cell count and viability data was collected with hemocytometer using trypan blue staining. Cells were seeded at a density of 20000 cells/well with 500 μl growth media per well and incubated in humidified 5% CO2 incubator at 37° C. for 2 days prior to the experiment. Further, PC3 cells were washed with 1×PBS then fixed in 2% formaldehyde in PBS for 5 minutes at RT. Cells were then rinsed twice with 1×PBS followed by blocking with 5% BSA for 1 hour at RT.

Figure 9C:
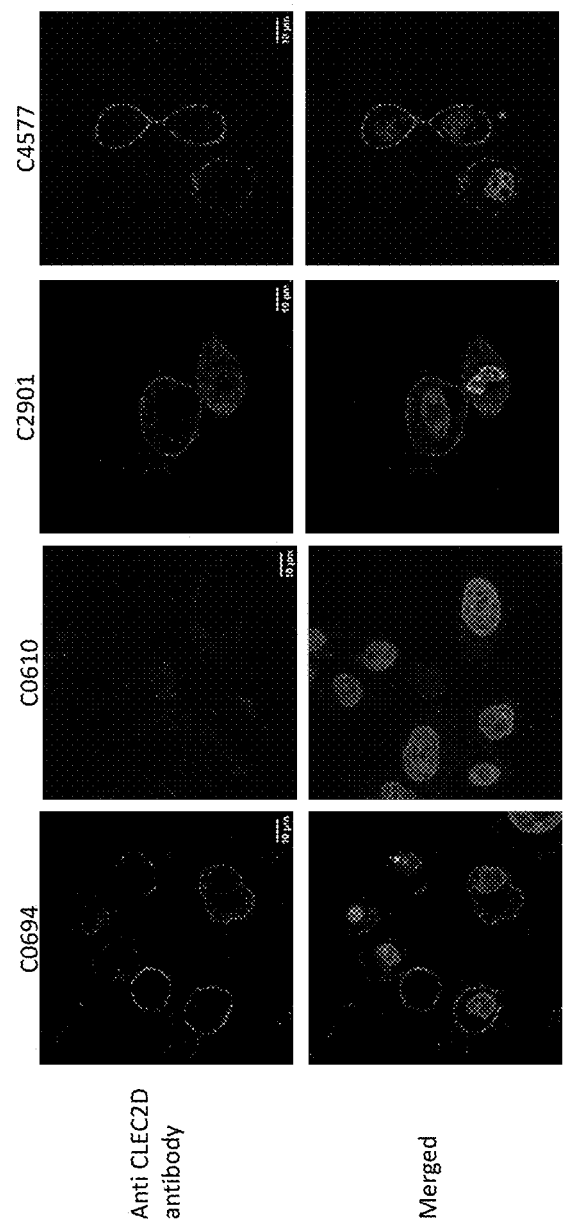

After 1 hour incubated with diluted test antibody samples i.e., novel and unique anti-CLEC2D Antibody (at 2 μg) and commercial antibody as reference control, for 1 hr at RT followed by washing for at least three times in PBS and then incubated with the Alexa Fluor 488 goat anti-human IgG and anti-mouse Alexa 488 (Thermo Fisher Scientific), respectively as applicable, secondary antibody, (at 2 μg) for 1 hour at RT. Cell nuclei were stained using DAPI (1:1000 for 5 min at RT). Cells were then rinsed thrice in 1×PBS and remained submerged in PBS until imaging. Immunofluorescence microscopy was performed on Olympus FV3000-4 laser scanning confocal microscope with a 60× magnification with 1.35-NA objective. Cells were imaged at 16 hrs after treatment by using appropriate wavelengths (For DAPI, $\lambda$ex 405 nm and $\lambda$em 430-470 nm; for Alexa 488, $\lambda$ex 488 nm and $\lambda$em 510-530 nm. Images were analyzed with Fiji ImageJ software. Variation on CLEC2D antigen binding of mAbs tested and binding data is given as a rating of + (low binding) to +++ (high binding) (Table 19, and FIG. 9C). A variation on surface binding was observed and binding data is given as a rating of +(low binding) to +++ (high binding) on Table 22 As exemplified, surface binding was not detected with mAbC4252, whereas with antibodyC0610, low binding was observed thereby rated as (+) while other clones have showed differential yet significant surface binding.

TABLE 22

| SI. No. | Codes | Titer data | Cell surface binding (Flow cytometry) | Imaging |
|---|---|---|---|---|
| 1 | CO294 | More than 100 μg | 5.23 | +++ |
| 2 | C5397 | More than 100 μg | 4.88 | +++ |
| 3 | C5852 | More than 100 μg | 5.79 | +++ |
| 4 | C3566 | More than 100 μg | 10.21 | +++ |
| 5 | C7229 | More than 100 μg | 4.84 | + |
| 6 | C2901 | More than 100 μg | 5.1 | +++ |

TABLE 22-continued

| SI. No. | Codes | Titer data | Cell surface binding (Flow cytometry) | Imaging |
|---|---|---|---|---|
| 7 | C4252 | More than 100 μg | 5.91 | Not detected |
| 8 | C4577 | More than 100 μg | 6.73 | +++ |
| 9 | C2685 | More than 100 μg | 9.78 | +++ |
| 10 | C5355 | More than 100 μg | 9.9 | ++ |
| 11 | C0610 | More than 100 μg | 8.62 | + |
| 12 | C8372 | More than 100 μg | 6.53 | + |
| 13 | C0694 | More than 100 μg | 8.43 | +++ |
| 14 | C6525 | More than 100 μg | 3.27 | + |
| 15 | C2771 | More than 100 μg | 7.94 | ++ |
| 16 | C0672 | More than 100 μg | 6.74 | + |
| 17 | C1063 | More than 100 μg | 1.96 | Not done |
| 18 | C4899 | More than 100 μg | 1.46 | Not done |
| 19 | C2302 | More than 100 μg | 7.72 | + |
| 20 | C3651 | 10 μg-100 μg | 4.73 | Not done |
| 21 | C6803 | More than 100 μg | 6.17 | Not done |
| 22 | C7997 | More than 100 μg | 4.62 | + |
| 23 | C2060 | More than 100 μg | 3.91 | +++ |
| 24 | C0997 | More than 100 μg | 6.45 | +++ |
| 25 | C2119 | More than 100 μg | 2.64 | ++ |
| 26 | C3482 | More than 100 μg | 4.17 | Not done |
| 27 | C9652 | More than 100 μg | 2.17 | Not done |
| 28 | C4148 | More than 100 μg | 6.34 | +++ |
| 29 | C0800 | More than 100 μg | 7.28 | +++ |
| 30 | CO225 | More than 100 μg | 5.14 | +++ |
| 31 | C9767 | More than 100 μg | 4.24 | + |
| 32 | C9795 | More than 100 μg | 4.69 | +++ |
| 33 | C5870 | More than 100 μg | 2.6 | +++ |
| 34 | C7009 | More than 100 μg | 2.18 | +++ |
| 35 | C8637 | 10 μg-100 μg | Not done | Not done |
| 36 | C5749 | 10 μg-100 μg | Not done | Not done |
| 37 | C3558 | 10 μg-100 μg | Not done | Not done |
| 38 | C5327 | 10 μg-100 μg | Not done | Not done |
| 39 | C4137 | 10 μg-100 μg | Not done | ++ |
| 40 | C6616 | 10 μg-100 μg | Not done | +++ |

Based on all of above mentioned criteria and respective observed results covering biophysical and functional properties of isolated anti-CLEC2D antibodies, 9 unique anti-CLEC2D antibody sequences, C5397, C5852, C3566, C2901, C4577, C2685, C0694, C0997, C0800, not limited to, and were selected for stable cell line development.

Generation of Stable Cell Lines

Clinical effectiveness has driven the commercial success of monoclonal antibody (mAb) products. As known to others, mammalian cells are currently the preferred system for large-scale production as the mAbs produced are biochemically similar to human forms. The stable cell line generation process is tedious and time-consuming as clones with high productivity, stable long-term expression and good product quality are rare occurrences. mAb production in mammalian cells can be performed either in transient or stable transfections. As seen in previous section, transient transfections allow relatively fast generation of small amounts of product for use during early stages of drug discovery. However, stably transfected cell lines are more widely used in large scale industrial production. More importantly, stable cell lines used for manufacturing are from a single cell clone in order to obtain high amounts of consistent product.

Antibiotic Selection:

Antibiotic selection was initiated after transfection at 90% cell viability. Cell suspension was centrifuged at 1400 RPM for 4 mins. Pellet was re-suspended in complete Power CHO2 growth media and concentration of Puromycin Dihydrochloride was adjusted to 2 μg/1×10^6 cells. Antibiotic selection was carried out on every 2nd or 3rd day. Refer table 5 for cell count and viability data.

TABLE 23

| Experiment | Viability (%) | Total cells/ml (×10⁶) | Viable cells/ml (×10⁶) | Passage No |
|---|---|---|---|---|
| Transfection R1 | 95.8 | 5.42 | 5.19 | 35 |
| Antibiotic selection 1 (AB 1) | 90.4 | 3.73 | 3.37 | 36 |
| Antibiotic selection 2 (AB 2) | 78.7 | 4.3 | 3.4 | 37 |
| Antibiotic selection 3 (AB 3) | 82.3 | 4.4 | 3.6 | 38 |
| Antibiotic selection 4 (AB 4) | 80.9 | 4.8 | 3.9 | 39 |
| Antibiotic selection 5 (AB 5) | 81.8 | 4.0 | 3.2 | 40 |
| Antibiotic selection 6 (AB 6) | 77.5 | 3.9 | 3.1 | 41 |
| Antibiotic selection 7 (AB 7) | 76.9 | 4.2 | 3.2 | 42 |
| Antibiotic selection 8 (AB 8) | 84.5 | 2.0 | 1.7 | 43 |

Repeat Transfection of Stable Pool

Cell count was taken using Vi-cell XR (Refer Table 10). Cells were subcultured before the transfection. Two more sequential transfections were performed as mentioned previously. On completion of three rounds of transfection the pool was designated as R3 stable pool. See Table 24.

TABLE 24

| Parameters | Transfection 1 | Transfection 2 | Transfection 3 |
|---|---|---|---|
| Total volume of transfection | 50 ml | 21 ml | 21 ml |
| Cell density | $1.25 \times 10^6$ cells/ml | $1 \times 10^6$ cells/ml | $1 \times 10^6$ cells/ml |
| OPTIMEM I | 12.5 ml | 1 ml | 1 ml |
| Total DNA | 25 µg | 5 µg | 5 µg |
| HC:LC | 1:3 | 1:3 | 1:3 |
| Amount of DNA:Lipofectamine | 1:3 | 1:3 | 1:3 |
| Amount of DNA:Plus reagent | 1:1 | 1:1 | 1:1 |

Minipool Plating

Minipools were generated by serial dilution method. Continuously growing culture of cell line was subcultured at 0.5 million cells/ml in 30 ml complete PowerCHO 2 growth media with 2 mM glutamax, 2 days before plating. Cell count and viability data was collected using Vi-cell XR (refer Table 25).

TABLE 25

| Experiment | Viability (%) | Total cells/ml (×10⁶) | Viable cells/ml (×10⁶) | Passage No |
|---|---|---|---|---|
| Minipool plating | 97.1 | 2.5 | 2.4 | 50 |

Serial dilution of the cell suspension was carried out in complete Power CHO2 growth media at 1:10 ratio (refer Table 26). 0.52 ml cell suspension was taken from dilution D and added to 25 ml of cloning media. Cells were seeded at a density of 10 cells/well in a 96 well plate in 200 µl volume per well. These mini-pools were maintained at 37° C. temperature in a humidified 5% CO2 incubator.

TABLE 26

| Dilution series | Cell count (cells/ml) | Cell count (cells/ml) |
|---|---|---|
| Culture flask | 2400000 | 1370000 |
| Dilution A | 240000 | 137000 |
| Dilution B | 24000 | 13700 |
| Dilution C | 2400 | 1370 |
| Dilution D | 240 | 137 |

Figure 10A:
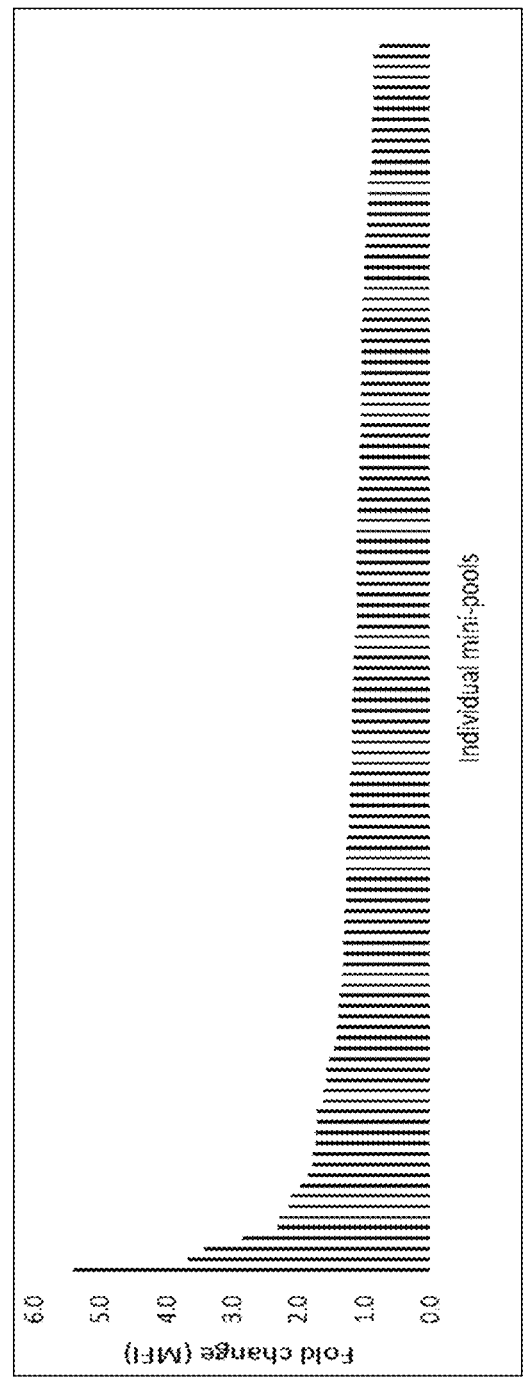

Screening of Mini-Pools and Amplification:

Total 117 mini-pools were screened by flow cytometry and binding to CHO cell surface expressed antigen was estimated. Minipools were ranked based on cell surface binding wherein the method of sample preparation for flow cytometry was as described above while ~200 µl of cell culture supernatant expressing anti-CLEC2D antibody proteins and reference positive control, respectively, was used to estimate the membrane bound CLEC2D binding on untransfected CHO cells and C4548 cells (FIG. 10A). Minipools identified from flow cytometry screening, as selected through extend of binding as derived from observed fold change in median fluorescence intensity, were amplified from 96 well plate to 24 well plate and maintained at 37° C., humidified condition in a 5% CO₂ incubator. These were further amplified from 24 well plate to one well of 6 well plate. After cell were confluent mini-pools were amplified from one well of 6 well plate to a bioreactor tube with 25 ml growth media and maintained at 37° C., humidified condition in a 5% CO₂ incubator, 200 rpm.

Single Cell Cloning

Single cells were generated by serial dilution method. Continuously growing culture of mini-pool was subcultured at 1 million cells/ml in 30 ml complete Power CHO 2 growth media with 2 mM glutamax, 1 day before cloning. Cell count and viability data was collected using Vi-cell XR. Serial dilution of the cell suspension was carried out in complete power CHO2 growth media at 1:10 ratio (refer Table 26). Cells were seeded at a density of 0.5 cells/well in a 96 well plate and maintained at 37° C. temperature in a humidified 5% CO2 static incubator. Cells were aspirated from dilution D and seeded at density of 0.5 cells/200 µl cloning media per well in 96 well plates. The plates were incubated at 37° C., in a 5% CO2 incubator with 75% relative humidity. Plates were scanned by using CloneSelect Imager (Molecular Devices) for monoclonality report generation from day zero to day ten. The individual well images were collected on day 0, day 1, day 2, day 3, day 6, day 8 and day 10. The clonal population was confirmed from the day zero image of entire well and the monoclonality report generated by CloneSelect Imager. Passage number was P(x+0).The Single cell clones were amplified to 24 well plates after cells were confluent. Passage number was P(x+1).

Screening of Single Cell Clones and Clone Amplification:

Cell surface binding assay was performed to estimate antibody in cell culture supernatant and to rank the clones. Single cell clones showing higher binding on CHO cell surface expressed antigen were amplified from 24 to 6 well after 2 days. Passage number was (x+2). This was followed by amplification in 3 wells of 6 well plate. Passage number was (x+3). The clones were further amplified to tube bioreactors in 20 ml volume, passage number was (x+4). Following amplification RCB vials were prepared for the clones at passage number (x+5).

Stable cell culture supernatant was estimated for binding with CLEC2D surface protein on C4548 cells through flow cytometry, wherein the method of sample preparation and experimentation for flow cytometry was as described above while ~200 μL of cell culture supernatant expressing anti-CLEC2D antibody proteins and reference positive control, respectively, was used to estimate the membrane bound CLEC2D binding on untransfected CHO cells and C4548 cells (FIG. 10B).

TABLE 27

| Experiment | Viability (%) | Total cells/ml (×10^6) | Viable cells/ml (×10^6) | Passage No |
|---|---|---|---|---|
| Transfection R1 | 95.8 | 5.42 | 5.19 | 35 |
| Antibiotic selection 1 (AB 1) | 90.4 | 3.73 | 3.37 | 36 |
| Antibiotic selection 2 (AB 2) | 78.7 | 4.3 | 3.4 | 37 |
| Antibiotic selection 3 (AB 3) | 82.3 | 4.4 | 3.6 | 38 |
| Antibiotic selection 4 (AB 4) | 80.9 | 4.8 | 3.9 | 39 |
| Antibiotic selection 5 (AB 5) | 81.8 | 4.0 | 3.2 | 40 |
| Antibiotic selection 6 (AB 6) | 77.5 | 3.9 | 3.1 | 41 |
| Antibiotic selection 7 (AB 7) | 76.9 | 4.2 | 3.2 | 42 |
| Antibiotic selection 8 (AB 8) | 84.5 | 2.0 | 1.7 | 43 |
| R1 Stable pool Subculture | 96.7 | 2.6 | 2.5 | 44 |
| R1 Stable pool Subculture | 98.3 | 3.5 | 3.4 | 45 |
| R1 Stable pool Subculture | 98.3 | 3.5 | 3.4 | 46 |
| Transfection R2 | 98.2 | 0.79 | 0.78 | 47 |
| Transfection R3 | 93.0 | 1.3 | 1.2 | 48 |
| Subculture | 93.8 | 2.3 | 2.1 | 49 |
| Minipool plating | 97.1 | 2.5 | 2.4 | 50 |
| Minipool screening and amplification | NA | NA | NA | 51-53 |
| Mini-pool subculture and RCB | NA | NA | NA | 54 to 59 |
| Single cell cloning of Mini-pool | 97.50% | 1.41 | 1.37 | 60 |

Selection of Monoclonal Antibody Clones Expressed and Purified from Stable Cell Lines Culture Harvest for Protein Purification:

Cells were seeded at a density of approximately $0.3 \times 10^6$ cells/ml in 30 ml Complete power CHO2 growth media and cultured for 6 days in 37° C., humidified condition in a 5% $CO_2$ incubator with 120 RPM rotation. 20 ml media top-up was given with complete power CHO2 growth media on 4th day. Cells were harvested by centrifuging the entire cell suspension at 2000 RPM for 10 mins. The supernatant was collected and stored in −20° C. for further purification. Here onwards, all respective stable cell clones containing novel, unique anti-CLEC2D antibody genes will be referred as Cxxxx, wherein xxxx represents four digit numbers (Table 19). Each code represents a specific stable cell line containing specific antibody gene, otherwise mentioned elsewhere.

Subsequently, culture supernatants of ~221 unique and confirmed stable cell clones were subjected to purification through Protein A followed through rational judgement on parameters as exemplified by yet not limited to, purity, titre. In addition, thermal stability estimation via thermal shift assay (TSA) was incorporated as an additional parameter towards selection/screening.

Higher melting temperature was considered as a characteristic of more stable protein while proteins with melting temperature less than 65° C. were decided to be not included for further development. TSA experimentation starts with appropriate dilution of protein sample to 0.5 mg/ml concentration in 1×PBS wherein SYPRO-ORANGE fluorescent dye (5000×) was added to the target protein to a final concentration of 5×. Further mixture was centrifuged at 500 RPM for 2 minutes and analyzed by CFX96 Real Time System. Thermal denaturation was carried out by increasing the temperature from 25° C. to 95° C. at a rate of 0.5° C. per minute. Fluorescence intensity was collected at 0.5° C. intervals and analyzed with CFX Maestro software and Tm value was calculated from melt curve.

Flow and/Imaging:

In addition, respective purified anti-CLEC2D proteins were also evaluated for Cell surface binding assay by flow-cytometry and confocal microscopy. The rationale behind inclusion of flow cytometry and confocal microscopy studies was to obtain comprehensive list of anti-CLEC2D clones through a combination ranking matrix.

Figure 10C:
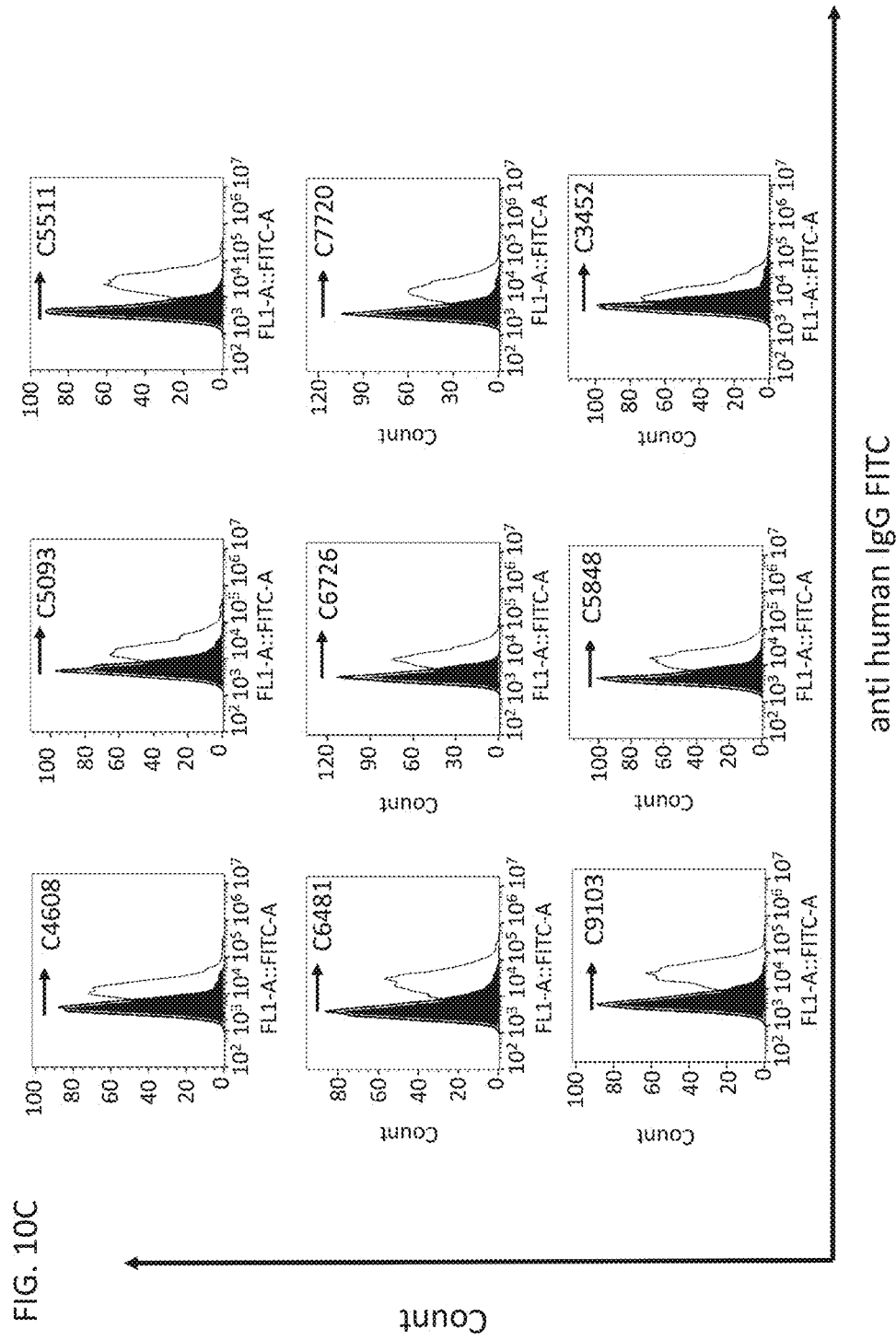

The experimentation including the method of sample preparation for flow cytometry was as described above while ~1-5 μg of purified anti-CLEC2D antibody proteins and reference positive control, respectively, was used to estimate binding of membrane expressed CLEC2D on untransfected CHO cells and C4548 cells (FIG. 10C).

The experimentation including the method of sample preparation for imaging acquisition through confocal microscopy was as described above while ~2 μg of purified anti-CLEC2D antibody proteins, such as, C5848, C8408, C7832, C8800, C5595, C0694, not limited to, and reference positive control, respectively, was used to monitor the membrane bound CLEC2D antigen binding on PC3 cells. As observed through imaging studies for Anti-CLEC2D purified from stable cell clones, not limited to, C5848, C8408, C8800, C5595, C7832, exhibits uniform yet differential CLEC2D antigen binding on the surface of PC3 cells (FIG. 10D).

In order to assess/understand the stability of anti-CLEC2D antibody genes in stable cell clones, quantitative measurements through RT PCR was adopted wherein amplification of stably integrated anti-CLEC2D antibody genes into CHO cell genome would be monitored and estimated. CHO cell pellets were obtained from every passage as part of a continuous subculture of respective clones for 60 generations corresponding to P01 as first passage while P18 represents final $60^{th}$ generation. Herein, genomic DNA (gDNA) were isolated from cell pellets using the DNeasy® Blood & Tissue kit (QIAGEN GmbH, Hilden, Germany) according to the manufacturer's protocol (protocol for cultured cells with proteinase K treatment). Concentration and purity of gDNA preparations were analyzed spectrophotometrically using Eppendorf BioPhotometer® D30 (Eppendorf AG, Germany). The isolated gDNA were diluted to a concentration of 100 ng/μL and passed through BD Ultra-Fine™ Needle Insulin Syringes (Becton, Dickinson and Company, NJ, USA) for qPCR. To quantify the Ct values qPCR was performed on a CFX96TMReal-Time system with 96-well, thin wall Hard-Shell PCR plates and Microseal® 'B' seal film sealer (all from Bio-Rad, Hercules, CA, USA) using the designed primers. Each qPCR run was performed with each sample in triplicates. GAPDH used as relative control and no template controls (NTC) were included in each qPCR run. Each reaction mix contained 12.5 μL of SYBR™ Green PCR Master Mix (appliedbiosystems by Thermo Fisher Scientific, Life technologies, Woolston Warrington, UK), 10 pmol of each primer (synthesised at Eurofins, Bangalore, India) and 100 ng lysed gDNA adjusted with Water, HPLC (HiMedia Laboratories, Mumbai, India) to a final volume of 25 μL. The qPCR run was performed as a 2-step protocol with an initial denaturation step at 95° C. for 10 min followed by 40 cycles of denaturation at 95° C. for 15 sec and annealing at 60° C. for 60 sec. Raw data were processed by the Bio-Rad CFX Manager™ software application version 3.1.1517.0823 (BioRad) using the settings baseline subtraction, to obtain the Cq (Cycle Quantification) values.

Figure 10E:
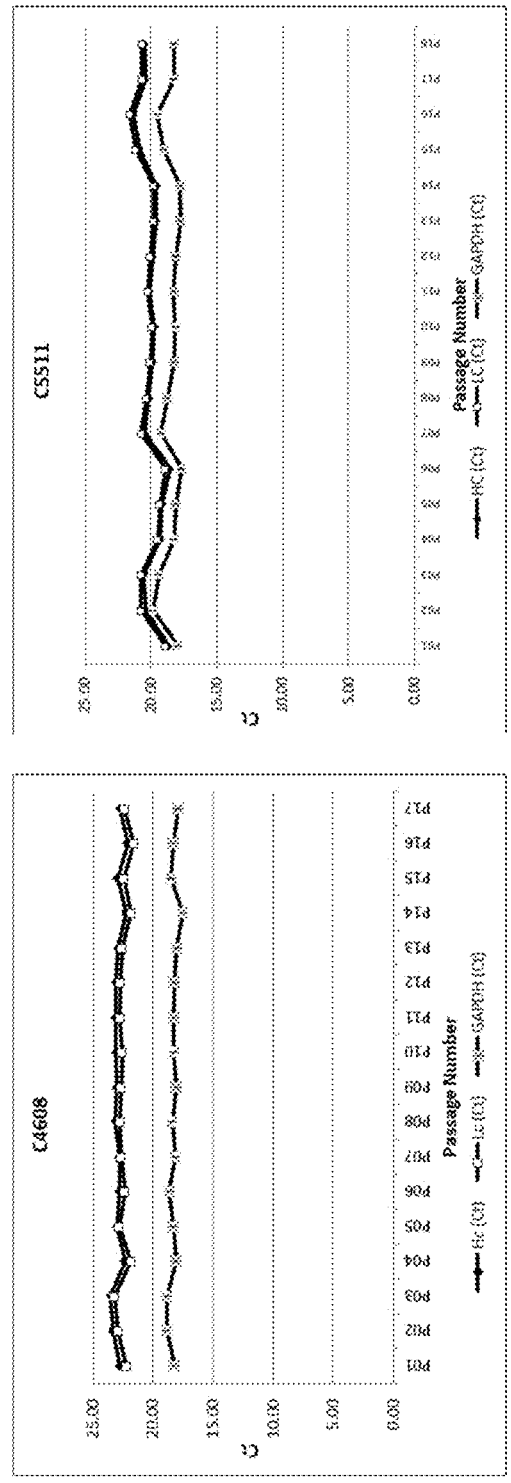

The described quantitative approach was employed for all clones, as exemplified by, for C5511, C4608. The data obtained from the study has been depicted in FIG. 10E. indicating non significant variation of <5% in Ct values for respective antibody chains across all passage numbers confirming the stable integration of anti-CLEC2D antibody genes into CHO cell genome and sustained for at least 60 generations.

Considering the combinatorial matrix, the number of stable cell line was selected to 11 clones, as exemplified by, C4608, C7720, C5093, C3452, C9136, C3641, C5372, C6481, C5511, C6726, C5392. Here onwards, understanding towards large scale production aspect and functionality feature, such as, anti-CLEC2D antibody driven cytotoxicity, was incorporated towards selection of final clones for further development.

For the process of clone selection, it was essential to have a method which is robust, repeatable and produces protein of consistent quality. Therefore, before clone screening was initiated, a platform process was developed to ensure efficient clone screening. A fed batch process was developed using ActiPro as basal media and cell boost 7a and cell boost 7b as the feeding. The interval and quantity of feeding was experimentally optimized and the optimized process was repeated to establish robustness. The fed process was further extended to clone screening to isolate the top performing clones. After the top performing clones were isolated, the clones were verified by culturing cells in a 10 L bioreactor using the optimized fed batch process. This step was carried out to ensure manufacturability of clones selected when transferred to a larger scale.

ActiPro media was chosen as the basal media for development of platform process, on the basis of historical data of comparison with different basal media. ActiPro was supplemented with 4 mM glutamine to ensure metabolic requirements of cell are met.

Multiple monoclonal cell lines were evaluated in order to understand, rank and select the better performers. Based on the results obtained on Viable Cell Density, Viability, Titer, C5511, C4608, C3452, C5392, C6481 were assessed to be best performers in terms of all the performance parameters.

Surface Antigen Expression on Various Prostate Cancer Cell Lines: PC3

Tumor cells expressing CLEC2D antigen were harvested by trypsinization. Cell count was taken by Vi-cell XR automated cell counter. Cells were centrifuged at 1400-1500 rpm for 4-5 minutes. The pellet was re-suspended in 1 ml DPBS. 50,000 cells were aliquoted in each well of a 96 well plate. 1 μg of test samples, as exemplified by C5511, control were added to each well and incubated for 30-60 minutes at room temperature (25° C.). The plate was centrifuged at 1400-1500 rpm for 4-5 minutes, the supernatant was aspirated and cells were washed with 0.1% BSA in DPBS. 2.5 ml of 2% BSA was diluted to 50 ml with DPBS. Goat anti human IgG FITC conjugate was used as secondary antibody. 1:100 dilution of secondary antibody was prepared in DPBS and 100 μl was added to each well. Goat anti human IgG FITC conjugate was used as control at dilution of 1:100. The plate was incubated for 30 minutes at room temperature (25° C.) in dark. The cells were washed with 0.1% BSA and re-suspended in 100 μl of 1% BSA. Samples were analyzed by flow-cytometry.

Binding of test samples were estimated and used for calculation of specific binding on tumor cell surface using following formula:

$$\text{Fold change in } MFI = \frac{\text{Median } FITC\text{-}A \text{ of test sample}}{\text{Median } FITC\text{-}A \text{ of control}}$$

Figure 11A:
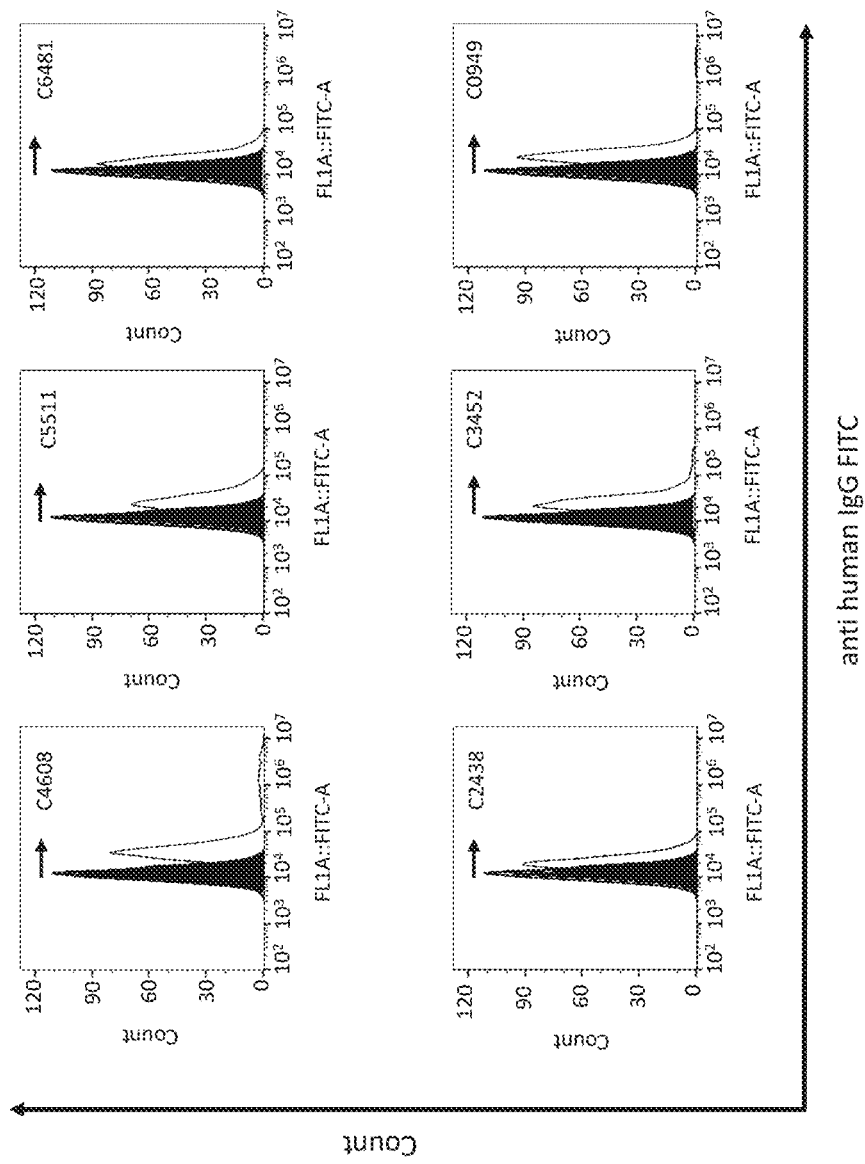

Fold change in MFI of PC3 surface binding, as observed from flow cytometry experiments, as exemplified while not limited to, C5511, C4608, C6481, C2438, C3452, C0949antibody, was found to be increased by more than 2 folds when compared against control (FIG. 11A).

Further, surface binding was with various unique anti-CLEC2D antibody stable clones on the surface of PC3 through binding of antibody on the surface of PC3 cells through confocal microscopy, as described in Example 5, Section: Cell surface binding assay: through Flow Cytometry and Confocal Microscopy. As depicted in FIG. 11A, the binding of purified novel anti-CLEC2D on the surface of PC3 was observed with uniform distribution of CLEC2D antigen through novel antibody on PC3 cells.

Cytotoxicity Assay: Through Flow Cytometry and Imaging Methods

To assess the functional activity of anti-CLEC2D, cytotoxicity assay was performed employing both flow cytometry and confocal microscopy methods, with isolated PBMCs and incubated with target cell and anti-CLEC2D. Prior to this, optimization on mAb concentration and ideal T:E ratio was carried out.

Effector cells, PBMCs from healthy donors were isolated as per previous protocol (Jewett A, J Immunol 1996). Briefly, peripheral blood lymphocytes were obtained after Histopaque-1077 (Sigma) centrifugation. 1:2 diluted blood was layered on 15 mL Histopaque. All the reagents were maintained in room temperature. Tube containing histopaque and blood was centrifuged at 400 g for 30 minutes at room temperature with zero acceleration and brake. After centrifugation, upper layer was carefully aspirated to within 0.5 cm of the opaque interface containing mononuclear cells and the upper layer was discarded. Opaque interface was carefully transferred into a centrifuge tube. Cells were washed twice by adding 10-15 mL of 1×PBS at 250 g for 10 minutes. Pellet was resuspended in 2 mL of PBS and PBMCs count was done. Total 10 million PBMC was obtained from 10 mL of blood. Quality check of PBMC was done based on flow cytometry with CD45+ population 99%. NK cells were isolated via negative selection using NK isolation kit (Stem cells technologies, Vancouver, BC, Canada). The purity of NK cells was found to be >90% based on flow cytometry CD56+ population.

Target prostate cancer cell line, PC3 cells were labelled with Efluor as per the manufacturer's protocol and were seeded at a density of 0.04×10⁶ in 20% DMEM in 24 well plates. After 24 hours, freshly isolated PBMCs were added in T:E of 1:5. Novel monoclonal anti-CLEC2D antibodies C5511, C6481, C5392, C3452 and C4608, not limited to, were added at ~200 μg/ml in the assay reaction of 0.5 ml and incubated for 14 hours. Supernatant was collected from 24 well plate and adherent cells were trypsinized and collected in 1.5 ml tubes. Reaction mixture was incubated with sytox green (15 nM) for 20 min and fluorescence was detected in flow cytometer. Percent specific cell death was determined by subtracting the percent cell death of control from the test samples.

Figure 11B:
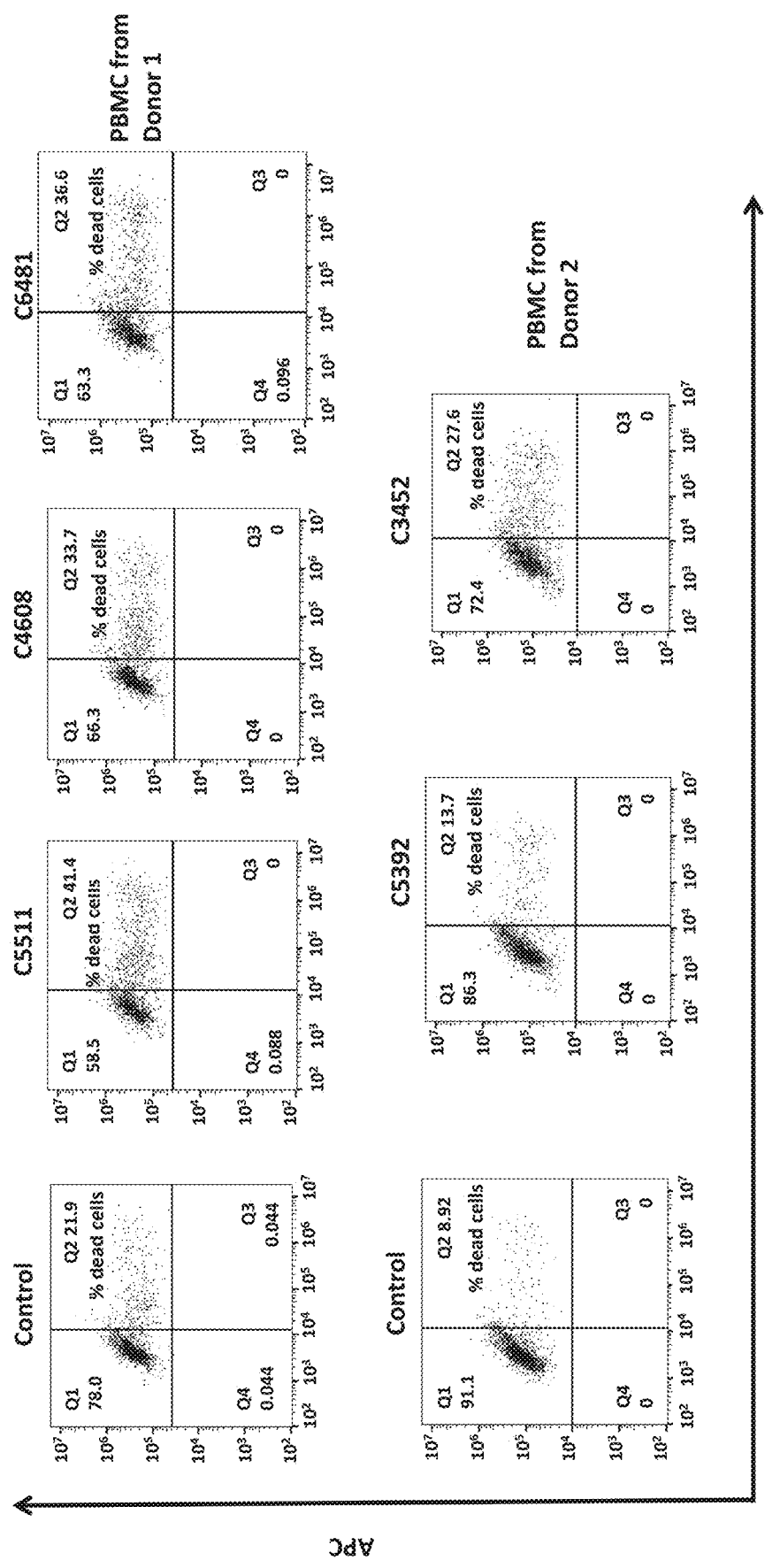
Figure 11C:
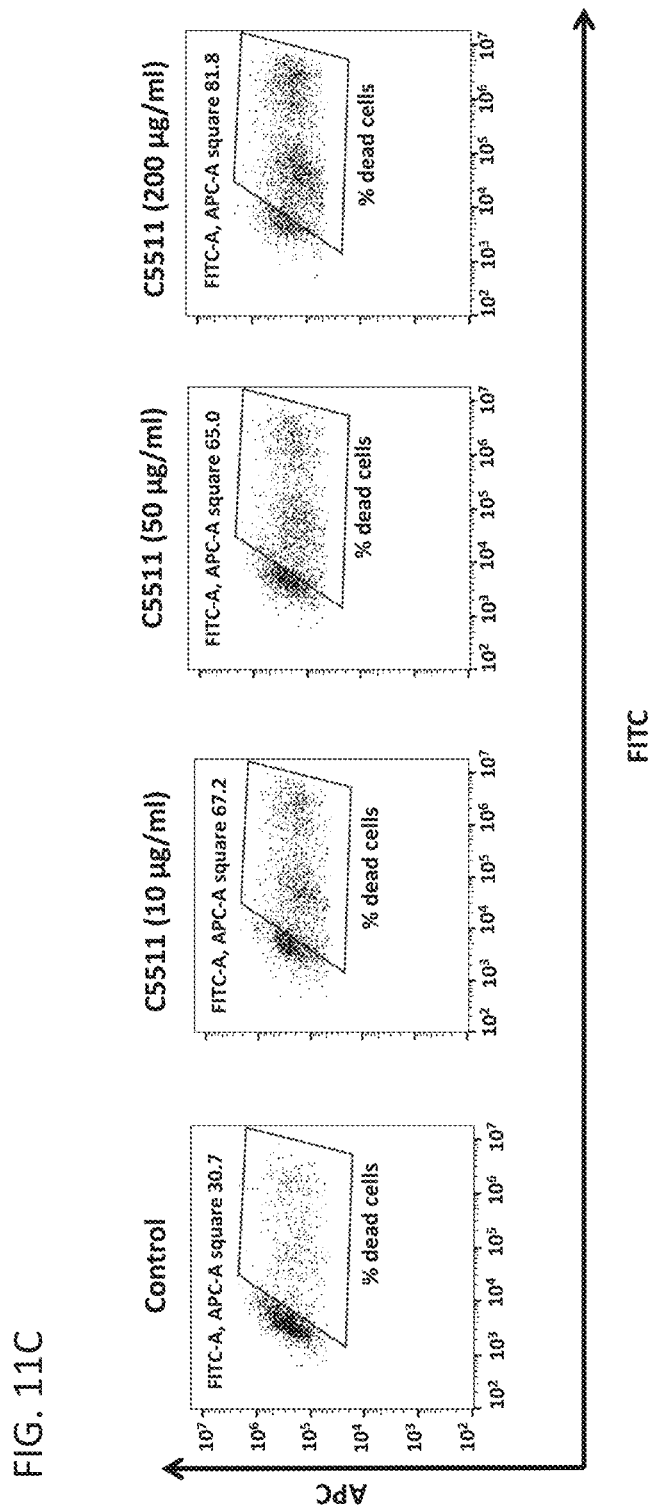
Figure 11D:
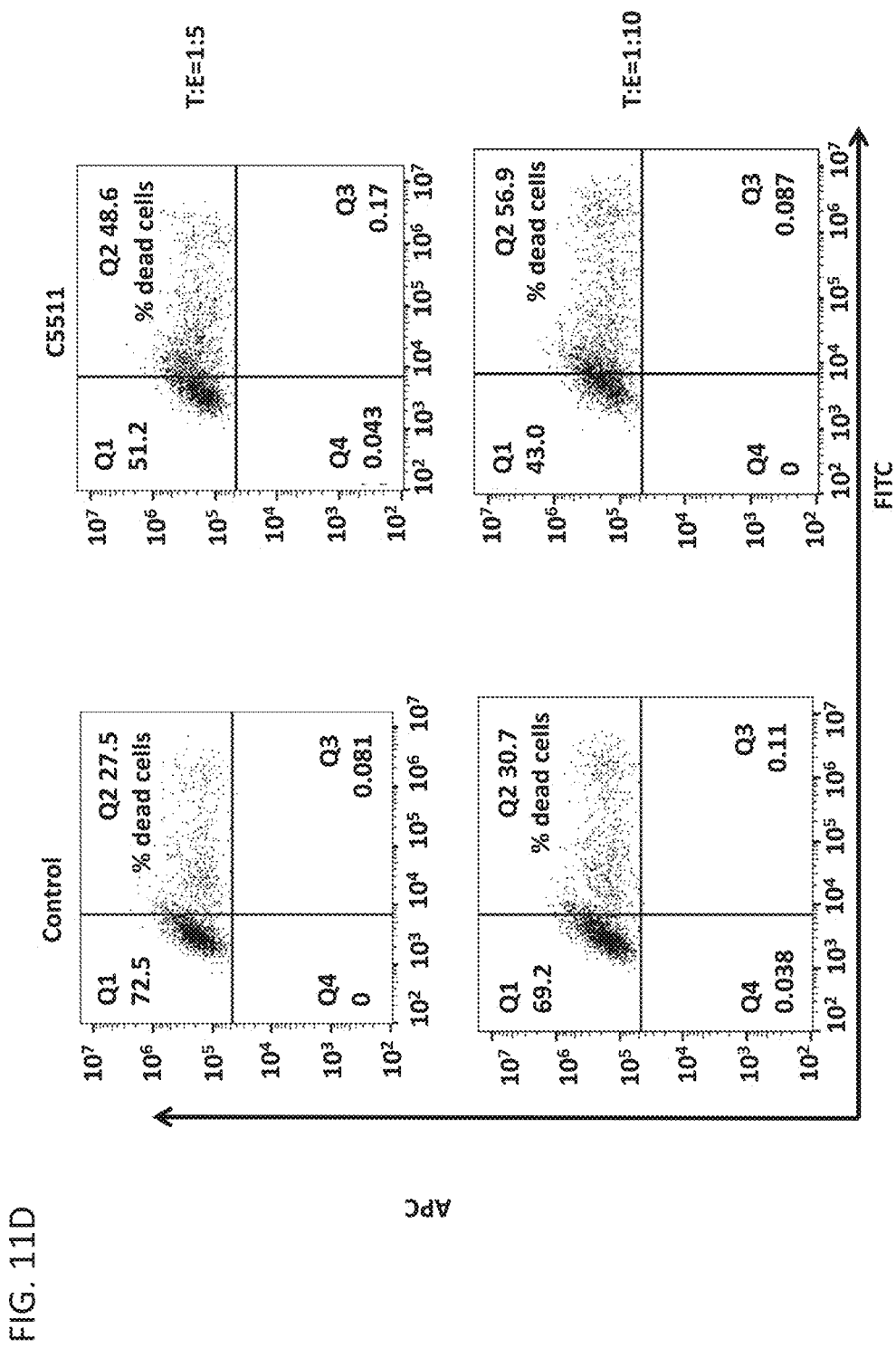

Cytotoxicity was analysed by dual target cell staining by flow cytometry. FIG. 11B shows cytotoxicity of the 3 novel anti-CLEC2D monoclonal antibodies, C5511 (~41%), C4608 (~32%) and C6481 (~37%) was observed compared with the control wherein percent cell death was measured from PBMC, isolated from donor 1, and target cell, incubated together at 1:5 ration without treatment. Following similar conditions, C5392 and C3452 clones were tested on donor 2 wherein cytotoxicity was found to be be ~14% and ~28%, respectively (FIG. 11B). More than 80% cytotoxicity of target cells was observed when anti-CLEC2D concentration was increased from 50 µg/ml to 200 µg/ml (FIG. 11C) and significant increase in tumour cell killing was also monitored when T:E ratio was increased from 1:5 to 1:10 (FIG. 11D).

For confocal microscopy experiments, PC3 cells were grown on 8-well slides (eppendorf) in complete media (20% FBS+DMEM-F12+1× Pen/Strep+1 mM sodium Pyruvate) to 70-80% of confluence. Freshly isolated PBMC cells were left overnight in culture media (RPMI1640 with 10% FBS) prior to be used in cytotoxicity as resting PBMC cells. PC3 cells were stained with cell tracker dye (100 nM) and PBMC cells were stained with cell proliferation dye EF670 (10 µM) separately. Different concentrations of novel antibodies along with stained PC3 and PBMC cells incubated for 6-7 hrs then images were acquired using Olympus FV3000-4 laser scanning confocal microscope with a 60× magnification, 1.35-NA objective. Laser light used for death dye sytox blue (at 5 µM), λex 405 nm and λem 450-500 nm; for cell tracker green, λex 488 nm and λem 510-530 nm; for cell proliferation dye EF670 λex 640 nm and λem 650-750 nm. Images were analyzed with Fiji ImageJ software.

Figure 11E:
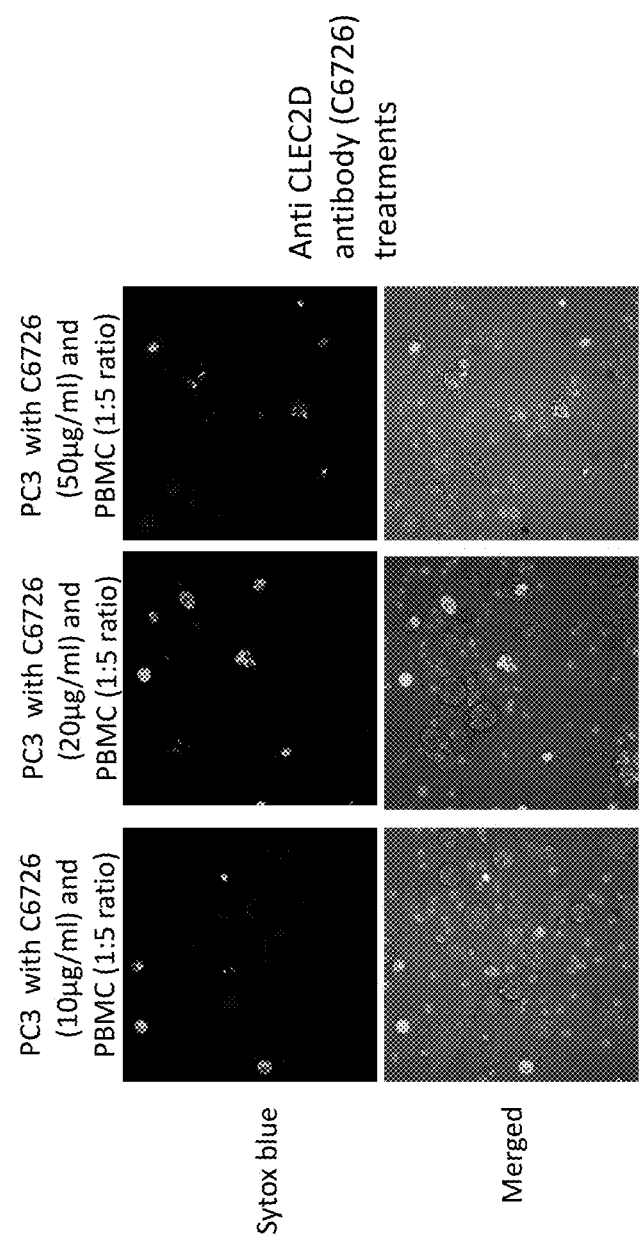
Figure 11F:
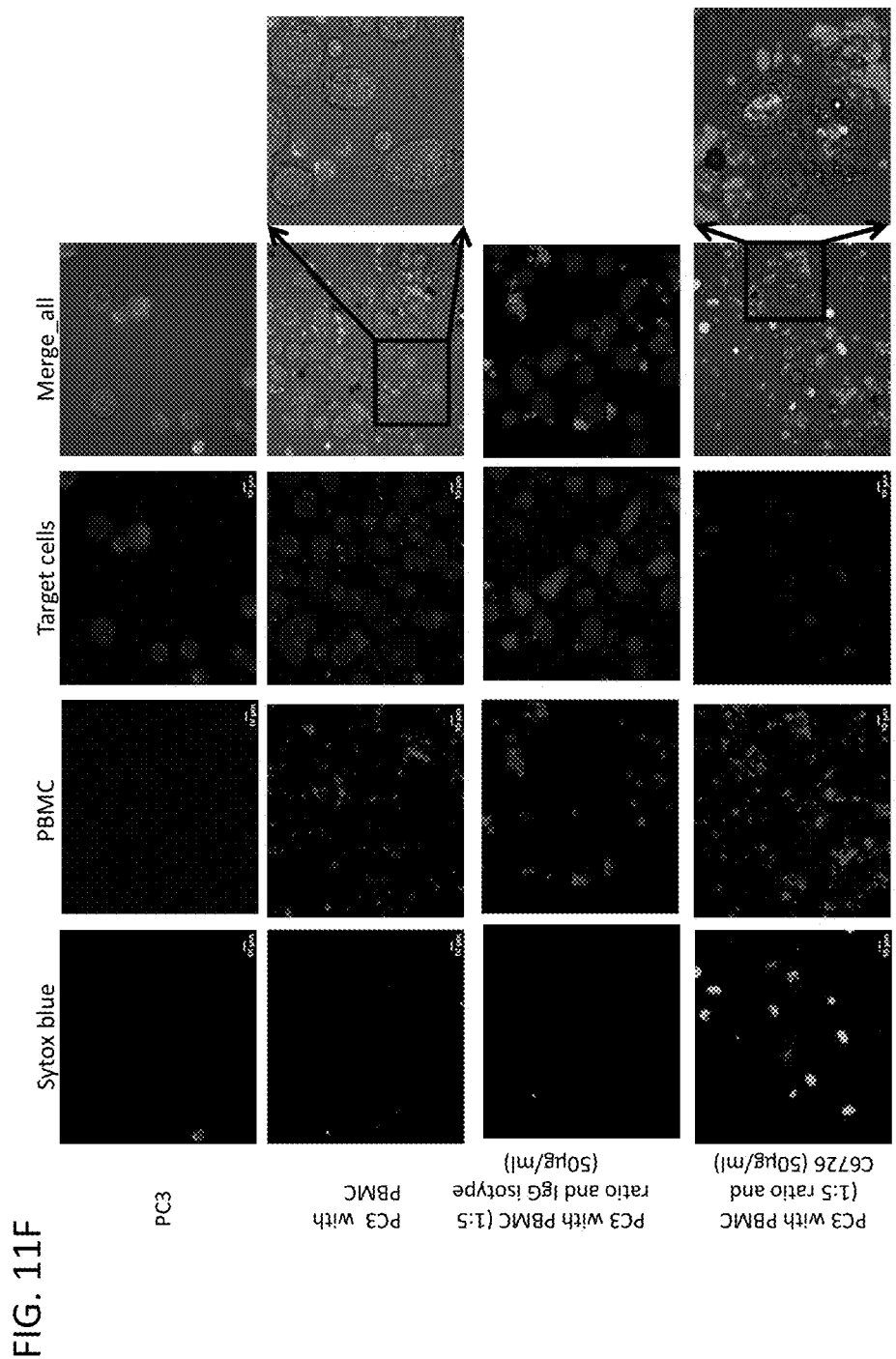
Figure 11F:
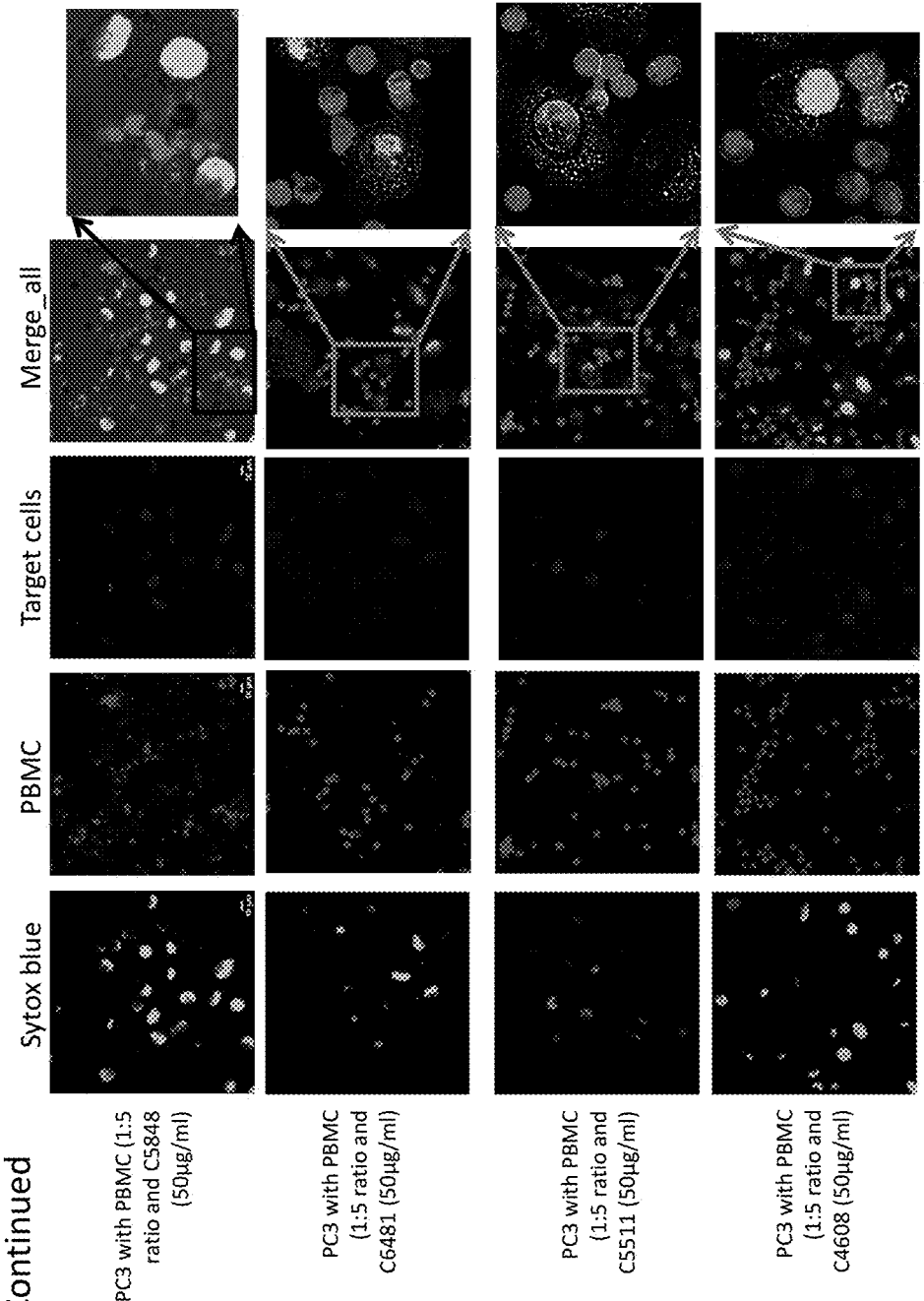

In order to identify the optimal concentration of novel mAb for the cytotoxicity assay, target to effector cells ratio (1:5) and 3 different concentrations (i.e., 10 µg/ml, 20 µg/ml and 50 µg/ml) of novel anti-CLEC2D antibody (C6726) was used and incubated for 6-7 hrs in complete media. Cell death was monitored by disappearance of green fluorescence and appearance of violet fluorescence on PC3 cells. Maximum cytotoxicity observed at 50 µg/ml (FIG. 11E). Further end point cell death assay was continued using a concentration of 50 µg/ml for the same incubation timing for other antibody clones, not limited to, C6726, C4608, C5848, C5511, C6481, clones tested (FIG. 11F) indicating that the target cell death is observed in the presence of novel antibodies while no cell death was monitored when targets cells were not treated with novel antibodies.

Based on available data as described above, C4608, C5511, C6481, C5392 and C3452 clones were selected for final in vivo mouse efficacy experimentation.

During the development of therapeutic monoclonal antibodies (mAbs), a strategy for early identification of candidate antibodies with the greatest likelihood of success in the clinic is needed to avoid costly late-stage failures related to inadequate exposure, toxicity or lack of efficacy. Early screening and optimization of mAbs focus on characteristics such as affinity, potency and stability for selection of lead constructs, while confirmation on in vivo efficacy are typically required, although, characterized later in development and on a small number of lead mAb constructs. Herein, confirmed anti-CLEC2D clones, C4608, C5511, C6481, C5392 and C3452 were subjected to evaluate for in vivo efficacy against prostate cancer xenograft.

Example 6: Deciphering the Mechanism of Action of Novel Anti-CLEC2D Antibody Molecule Immune checkpoints consist of inhibitory and stimulatory pathways that maintain self-tolerance and assist with immune response. In cancer, immune checkpoint pathways are often activated to inhibit the nascent anti-tumor immune response. Immune checkpoint therapies act by blocking or stimulating these pathways and enhance the body's immunological activity against tumors. Under normal circumstances, immune checkpoints allow the immune system to respond against infection and malignancy while protecting tissues from any harm that may derive from this action. However, the expression of some of these immune-checkpoint proteins by malignant cells dysregulates the antitumor immunity and favours the growth and expansion of cancer cells. Understanding the mechanism of action for immunotherapy, especially though monoclonal antibody based therapies, though multiple approaches would further reinvigorates on specific ways whether alone or in combination, that works in favour of tumour cell killing.

In present disclosure, mechanism of anti-CLEC2D antibody, as can be understood from in vitro experimentation, usually consists of events occurred at molecular interaction level, such as CLEC2D target dependence, interaction between CLEC2D/CD161, at cellular network level such as involvement of various effector cells, eg., natural killer (NK) cell, T cells on killing of tumour cells in presence or absence of anti-CLEC2D antibody, or specific mechanism that are driven by isotype of anti-CLEC2D antibody such as ADCC, CDC, ADCP and/or in combination, tumour cell death induced by elevation of cytokine/chemokine levels or various activating/inhibitory receptor's expression or in combination, and from in vivo experimentation, wherein, tumour regression occurred through lymphocyte infiltration.

Moreover, as the functions and target molecules of antibodies are more diverse, it becomes increasingly necessary to understand how the target molecule functions biologically and what will be the biological response to the modified functions induced by the antibody. Having mentioned this, understanding on mechanism of action will have immense emphasis on prostate cancer treatment, specifically on castration resistant prostate cancer, and will pave avenues for whole spectrum of multiple disease indications with novel immunotherapy strategies. Having mentioned this, a thorough employment of rational approach/stratification will ensure consistent incorporation of better-understood immunology in to cancer therapy and will dramatically impact on the development of overall therapeutic landscape.

The specific cell type involved in cytotoxicity was investigated through flow cytometry and confocal microscopy, wherein, in microscopy based approaches having both end point assay and live cell imaging methods.

Figure 12A:
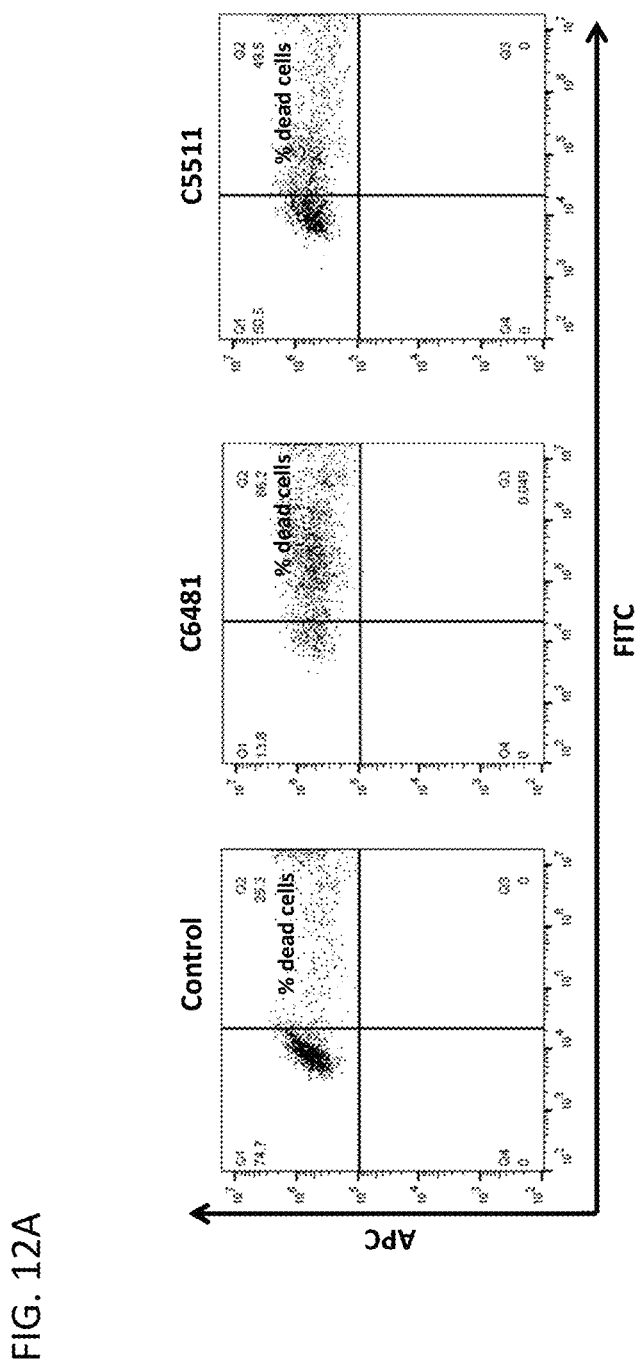

NK Cell Mediated Cytotoxicity PC3 cells were labelled with Efluor as per the manufacturer's protocol and were seeded at a density of $0.04 \times 10^6$ in 20% DMEM in 24 well plates. After 24 hours, freshly isolated NK cell was added in T:E of 1:1. Novel monoclonal anti-CLEC2D antibody C5511 and C6481 were added at 100 µg/ml in the assay reaction of 0.5 ml and incubated for 14 hours. Supernatant was collected from 24 well plate and adherent cells were trypsinized and collected in 1.5 ml tubes. Reaction mixture was incubated with Sytox green (15 nM) for 20 min and fluorescence was detected in flow cytometer. Percent specific cell death was determined by subtracting the percent cell death of control from the test samples. NK cell-mediated cytotoxicity (NKCC) was determined by using freshly isolated NK cells co-incubated with prelabelled target tumor cell line and anti-CLEC2D for 14 hours. Assay samples were incubated with dead cell dye sytox green and fluorescence was measured by flow cytometry. As estimated, Anti-CLEC2D antibody exhibited more than 80% cell death in the cytotoxicity assay (FIG. 12A).

Confocal microscopy based approach was employed further to understand the impact of NK cell mediated cytotoxicity through both fixed cell imaging and live cell imaging.

PC3 cells were grown on 8-well slides (eppendorf) in complete media (20% FBS+DMEM-F12+1× Pen/Strep+1 mM sodium Pyruvate) to 70-80% confluence. NK cells were isolated as described above. Freshly isolated NK cells were left overnight in in 10% RPMI media overnight prior to be used in cytotoxicity as resting NK cells. PC3 cells were stained with cell tracker dye and NK cells were stained with cell proliferation dye EF670 separately. Different ratio of NK:target cells (1:0.5, 1:5, 1:10) were used along with 50 µg/ml of novel antibodies, not limited to, C5511, C4608, C6481, and were incubated for 6-7 hrs before image acquisition using Olympus FV3000-4 laser scanning confocal microscope with a 60× magnification, 1.35-NA objective. Laser light used for death dye sytox blue, λex 405 nm and λem 450-500 nm; for cell tracker green, λex 488 nm and λem 510-530 nm; for cell proliferation dye EF670 λex 640 nm and λem 650-750 nm. Images were analyzed with Fiji ImageJ software.

Figure 12B:
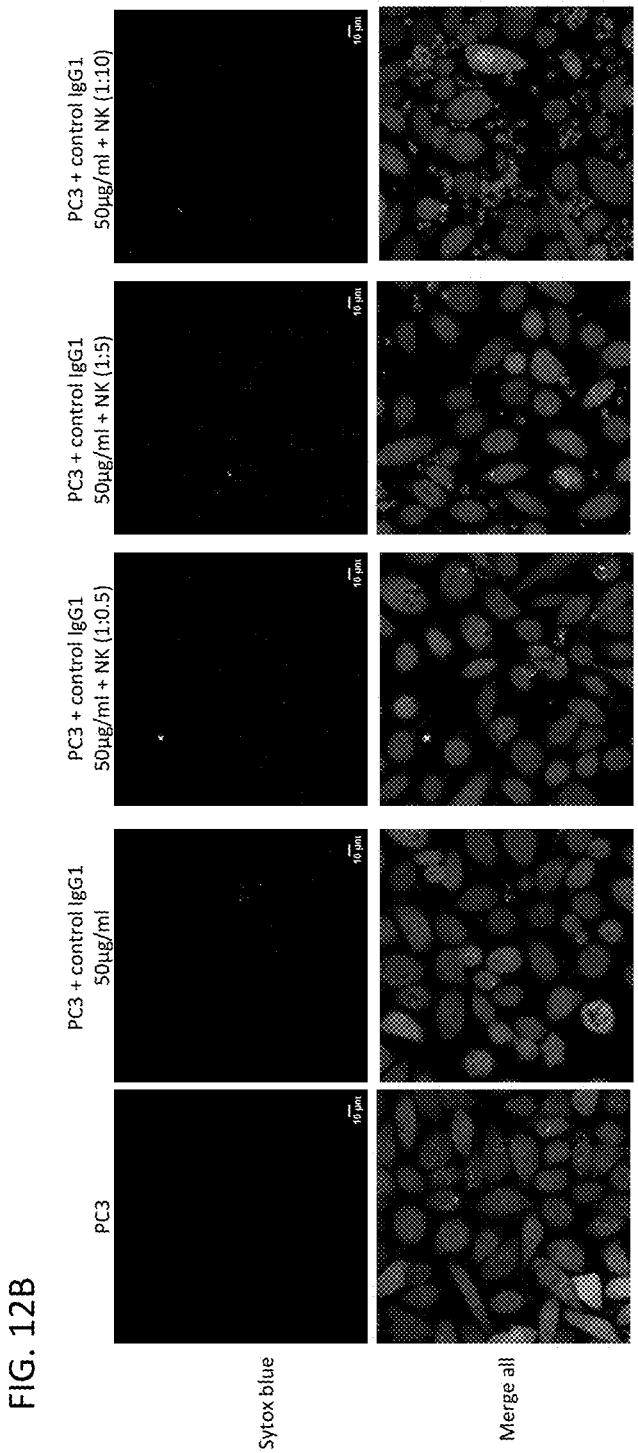
Figure 12C:
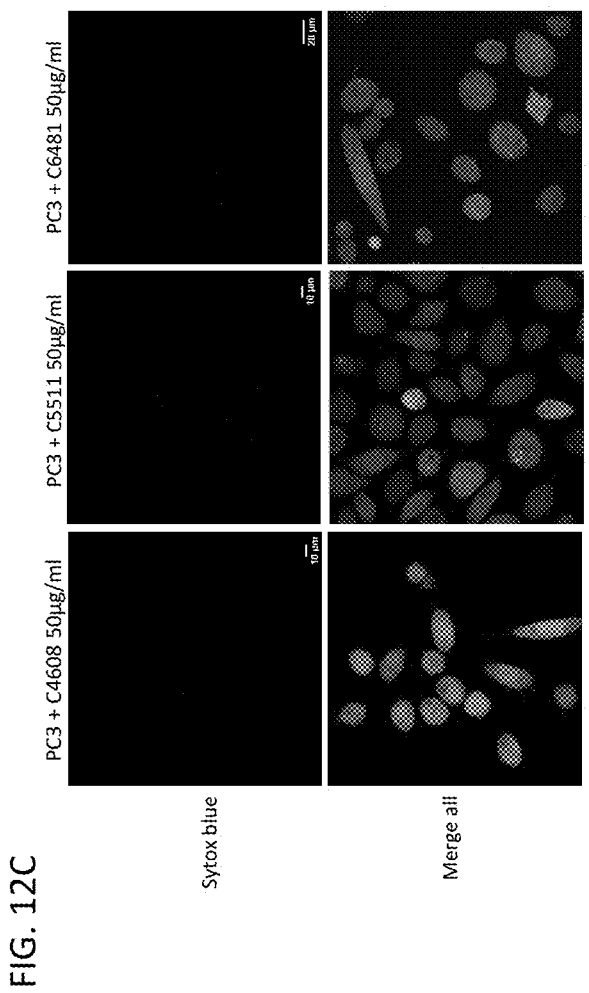
Figure 12D:
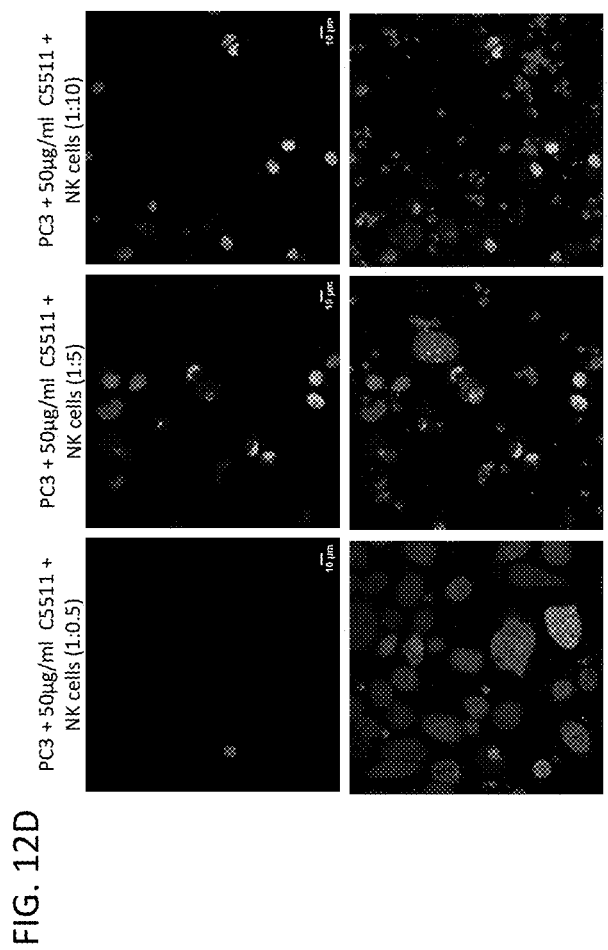

To explore the role of NK cells on cytotoxicity, we have incubated PC3 with different ratio of NK cells along with the fixed concentration of novel antibodies for 6 to 7 hrs. We have observed an increase in cell death with increasing in ratio of E:T for all antibodies tested (C5511, C4608, C6481) wherein T:E ratio of 1:10 exhibited highest cell death as indicated in FIGS. 12B, 12C, and 12D).

T Cell Mediated Cytotoxicity

PC3 cells were labelled with Efluor as per the manufacturer's protocol and were seeded at a density of 0.04×10$^6$ in 20% DMEM in 24 well plates. Freshly isolated T cell was used in the cytotoxicity assay at T:E of 1:3 and antibody concentration of 100 ug/ml. Novel monoclonal anti-CLEC2D antibody C5511 and C6481 were added at 100 ug/ml in the assay reaction of 0.5 ml and incubated for 14 hours. Supernatant was collected from 24 well plate and adherent cells were trypsinized and collected in 1.5 ml tubes. Reaction mixture was incubated with sytox green (15 nM) for 20 min and fluorescence was detected in flow cytometer. Percent specific cell death was determined by subtracting the percent cell death of control from the test samples.

Figure 13:
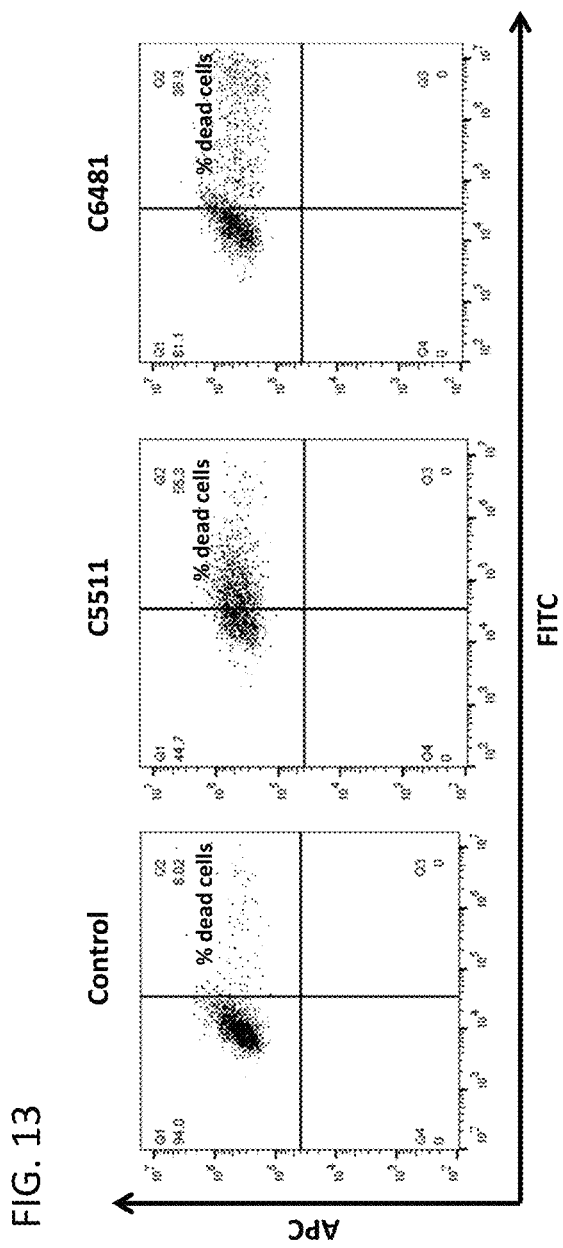
FIG. 13 illustrates cytotoxicity of PC3 tumor cells treated with isolated T cells and anti-CLEC2D antibodies (C5511 & C6481) at 100 ug/ml. The percentage of dead PC3 tumor cells indicated by Sytox green-positive cells.
Figure 14B:
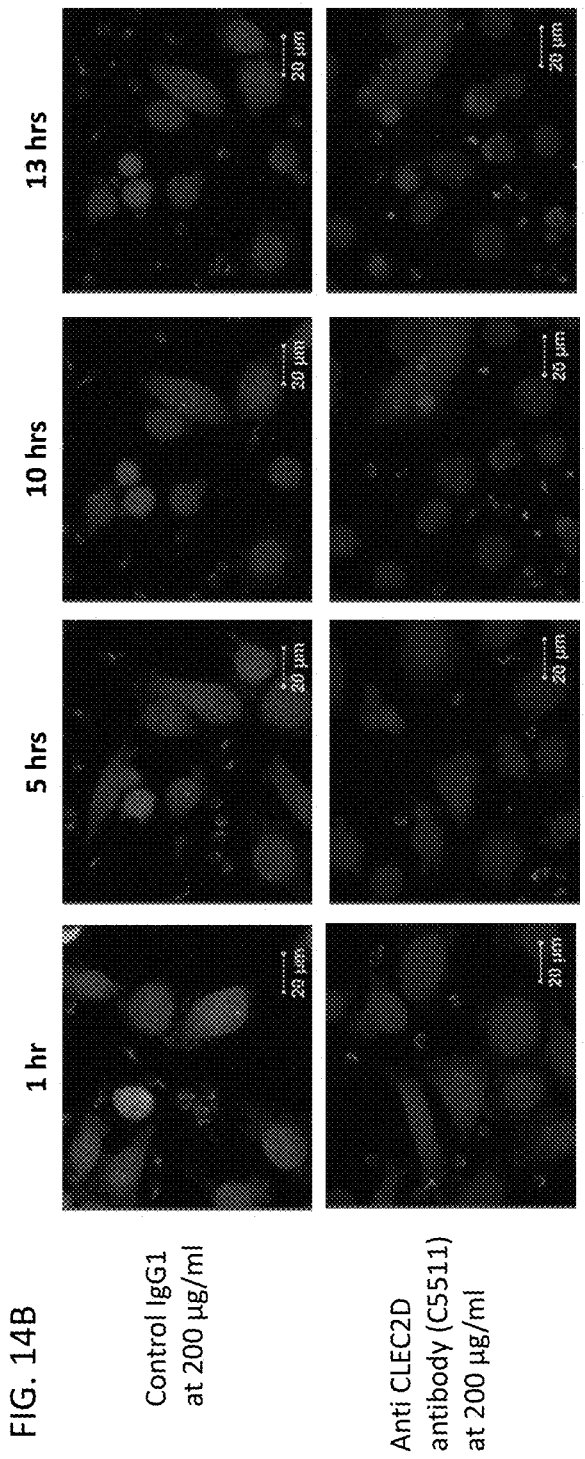

FIG. 13 depicts T cell mediated killing as observed against PC3 cells wherein clone C5511 & C6481was incubated at a concentration of 100 µg/ml eliciting tumor cells cytotoxicity when compared with control having basal level of 6% dead cell. In experimental condition where T:E of 1:3 was used, upto 55% T cell mediated cytotoxicity was observed (FIG. 13).

To further define the process of cytotoxicity live-cell microscopy experiments were performed to track the target cell killing through effector cells for both PBMC and NK cells. For live cell imaging experimentation, PC3 cells were grown on 8-well slides (eppendorf) in complete media ((20% FBS+DMEM-F12+1× Pen/Strep+1 mM sodium Pyruvate)) to 70-80% confluence. PC3 cells were stained with cell tracker dye and PBMC/NK cells were stained with cell proliferation dye EF670 separately. 200 m/ml of novel antibodies along with stained PC3 and PBMC/NK cells. Target to effector ratio for both PBMC and NK cells were, 1:5 and 1:1, respectively. Cells were kept in a humidifier maintained at 37° C. and 5% CO2 during imaging. Live cell imaging was performed on the Zeiss LSM800 confocal microscope with a 63× magnification, 1.4-NA objective and images were captured at 8 min intervals for up to 20 hrs by using appropriate wavelengths (For sytox blue, λex 405 nm and λem 450-500 nm; for cell tracker green, λex 488 nm and λem 510-530 nm; for cell proliferation dye EF670 λex 630 nm and λem 650-750 nm. Images were analyzed with Zen lite Imaging software.

To further define the process of cytotoxicity, live-cell microscopy was performed to track the target cell killing through effector cells either PBMC or NK cells.

The purpose of live cell imaging was to understand and follow the anti-CLEC2D mediated tumour cell killing process in the presence of effector cells, such as PBMC or NK cell, in time dependent manner, under controlled experimental condition. Results obtained from live cell imaging prompted the fact that in the presence of isotype control, PBMC or NK cell made less direct contact with the PC3 target cells resulting in minor percentage of target cell death. On the contrary, addition of anti-CLEC2D (C5511) antibodies, on PBMC or NK cells and target cells causing an increase in extend of direct contacts between both PBMC or NK cells and PC3 target cells, resulting in significant target cell death. Interestingly, PC3 target cell killing mediated by anti-CLEC2D (C5511) antibody in presence of NK cells elicited more efficient clearance of tumor cells wherein most of the tumor cells lysis occurred within 10 hrs of incubation, while observed tumor cell death in presence of PBMC was found to be significantly lower within the said time point. This indicates that effective elimination of PC3 tumor cells via anti-CLEC2D antibody is predominantly NK cell mediated.

Molecular Interaction Between Anti-CLEC2D Antibody and CLEC2D Antigen: Through Epitope Mapping In Silico Studies The following protocol was developed to identify the binding site formed by the CLEC2D-Antibody complexes. Briefly the method involves using protein structures of both the antibody and CLEC2D in shape-complementarity based docking to generate CLEC2D-antibody conformations, followed by analysis of the conformation to shortlist mutations to verify the binding sites. (Germain et al, 2011, Rozbesky et al, 2015).

One of the central assumptions of this protocol is that the potential binding site should be more accommodating of a binding partner, i.e., a groove or channel—where an appropriate binding partner may be able to settle, somewhat illustrated by the lock-and-key model of enzymes and substrates, a specific lock (or binding site) would be receptive to a specific key (or binding partner) based on their structural compatibility. This concept was expanded upon to identify the binding site, as following shape-based docking, the largest concentrations of generated conformations were considered to be the possible binding sites.

The conformations were then clustered together on the basis of interacting pairs of residues, conformations that could not be incorporated into clusters were discarded after which the remaining conformations were energy minimized and screened for viability. For conformations found to be viable their interacting residue pairs were more closely scrutinized and mutations were suggested to test the association.

Killer cell lectin-like receptor subfamily B member 1 (NKR-P1) is an inhibitory receptor the regulates NK cell-mediated cytotoxicity. C-type lectin domain family 2 member D (CLEC2D) is a ligand of NKR-P1, the CLEC2D/CD161 interaction inhibits NK cell-mediated cytotoxicity, blocking the CLEC2D-NKR-P1 complex can enhance primary NK cell activity.

All unique anti-CLEC2D antibodies derived from novel library was found to prevent the CLEC2D-NKR-P1 association by binding with CLEC2D, however the exact location and nature of this inhibition was unknown. The following protocol was conceived to identify the likelihood of binding site through the use of modelling, docking and site-directed mutagenesis.

Figure 15A:
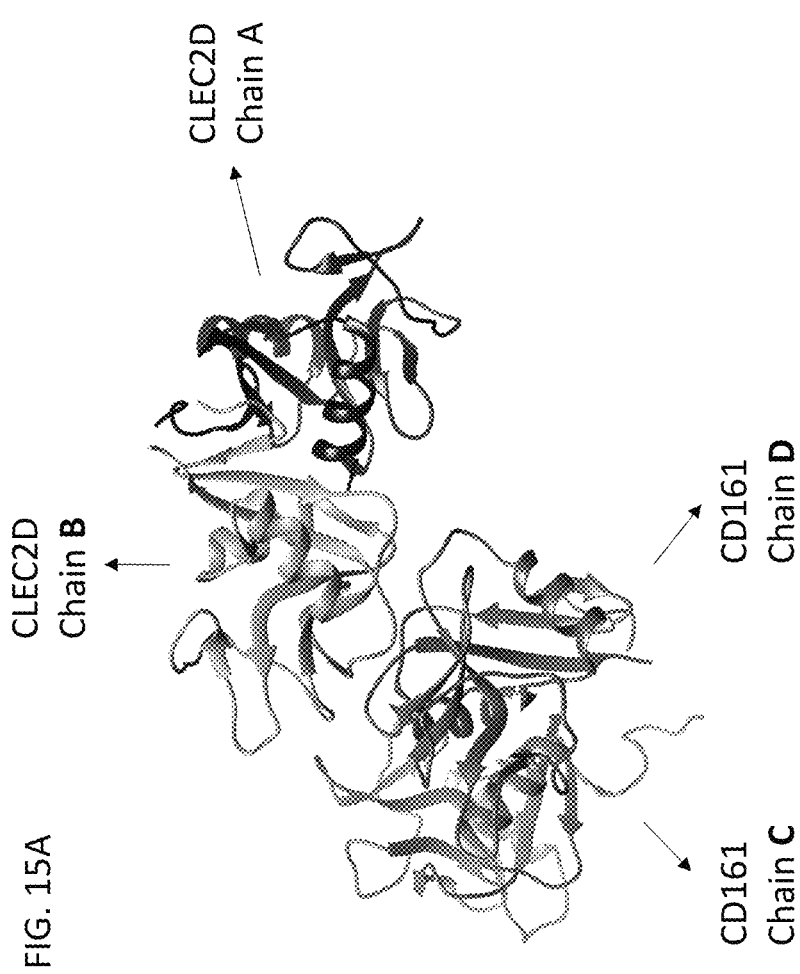

The procedure starts with identifying key interaction residues on CLEC2D wherein, the CLEC2D-antibody complex interactions can be understood by taking a closer look at the CLEC2D-NKR-P1 (CD161) complex and was done by studying the crystal structure of the complex, deposited in the PDB as 5MGT (FIG. 15A).

Figure 15B:
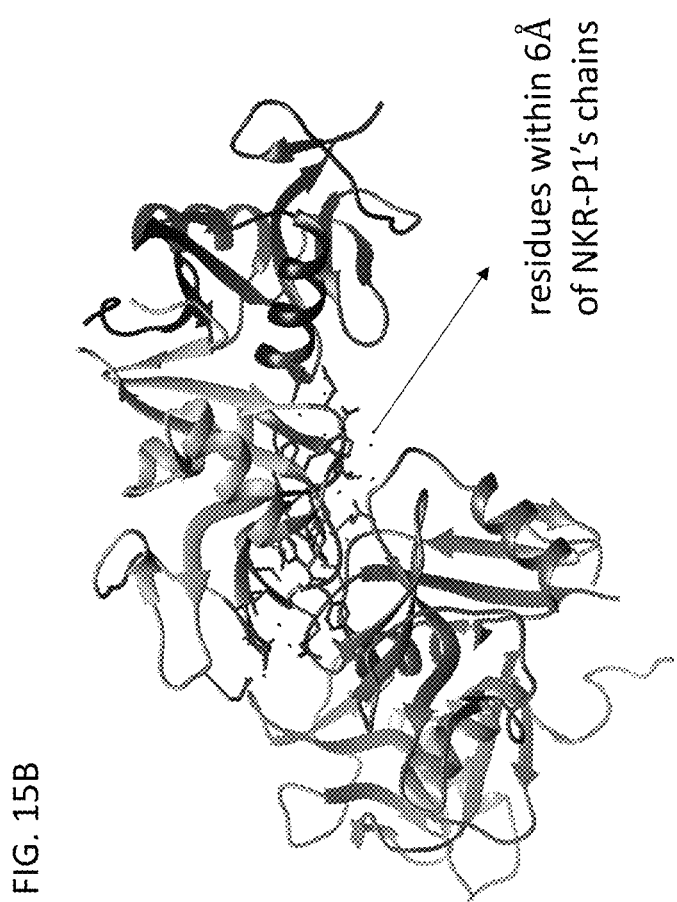

The 5MGT crystal structure describes the association between the CLEC2D and NKR-P1 complex. The residues involved in the association are of interest. If the inhibition mode of the antibody-CLEC2D complex is of a steric variety, the residues involved in both interactions, and their immediate neighbors, would likely overlap. Residues involved from the CLEC2D chains, henceforth called antigen interacting residues were identified by examining the 5MGT structure in Chimera (FIG. 15B) (Pettersen et al, 2004). Essentially all residues within contact distance (up to 6 Å) between the chains of CLEC2D and NKR-P1 (CD161) were identified (See Table 28).

TABLE 28

A list of the residues in CLEC2D Chains within contact distances of NKR-P1(CD161).

| Res No. & Type | 6 Å | 5 Å | 4 Å | Res No. & Type | 6 Å | 5 Å | 4 Å |
|---|---|---|---|---|---|---|---|
| 91 ASP | ✓ | ✓ | X | 161 GLY | ✓ | ✓ | X |
| 92 ASP | ✓ | X | X | 162 GLU | ✓ | ✓ | ✓ |
| 93 THR | ✓ | ✓ | X | | | | |
| 95 ASN | ✓ | X | X | 165 TYR | ✓ | ✓ | ✓ |
| | | | | 167 ASN | ✓ | ✓ | ✓ |
| 124 ARG | ✓ | X | X | 168 ASP | ✓ | ✓ | X |
| 126 LYS | ✓ | ✓ | X | 169 LYS | ✓ | ✓ | ✓ |
| 127 GLY | ✓ | ✓ | X | | | | |
| 128 PRO | ✓ | ✓ | ✓ | 172 SER | ✓ | ✓ | X |
| 129 SER | ✓ | ✓ | ✓ | 173 SER | ✓ | ✓ | ✓ |
| 130 ASP | ✓ | ✓ | ✓ | 174 ALA | ✓ | ✓ | ✓ |
| 131 HIS | ✓ | X | X | 175 ARG | ✓ | ✓ | ✓ |
| | | | | 177 TYR | ✓ | ✓ | ✓ |
| 139 GLN | ✓ | ✓ | ✓ | 178 THR | ✓ | ✓ | ✓ |
| | | | | 179 GLU | ✓ | ✓ | ✓ |
| 158 LEU | ✓ | ✓ | X | 180 ARG | ✓ | ✓ | ✓ |
| 159 GLY | ✓ | ✓ | X | 181 LYS | ✓ | ✓ | ✓ |
| 160 ALA | ✓ | ✓ | ✓ | | | | |

These antigen-interacting residues were known to play crucial roles in the NKR-P1 (CD161)-CLEC2D complex and would therefore be considered as 'significant' residues in the following conformation analysis.

Building Antibody Structures

Figure 15C:
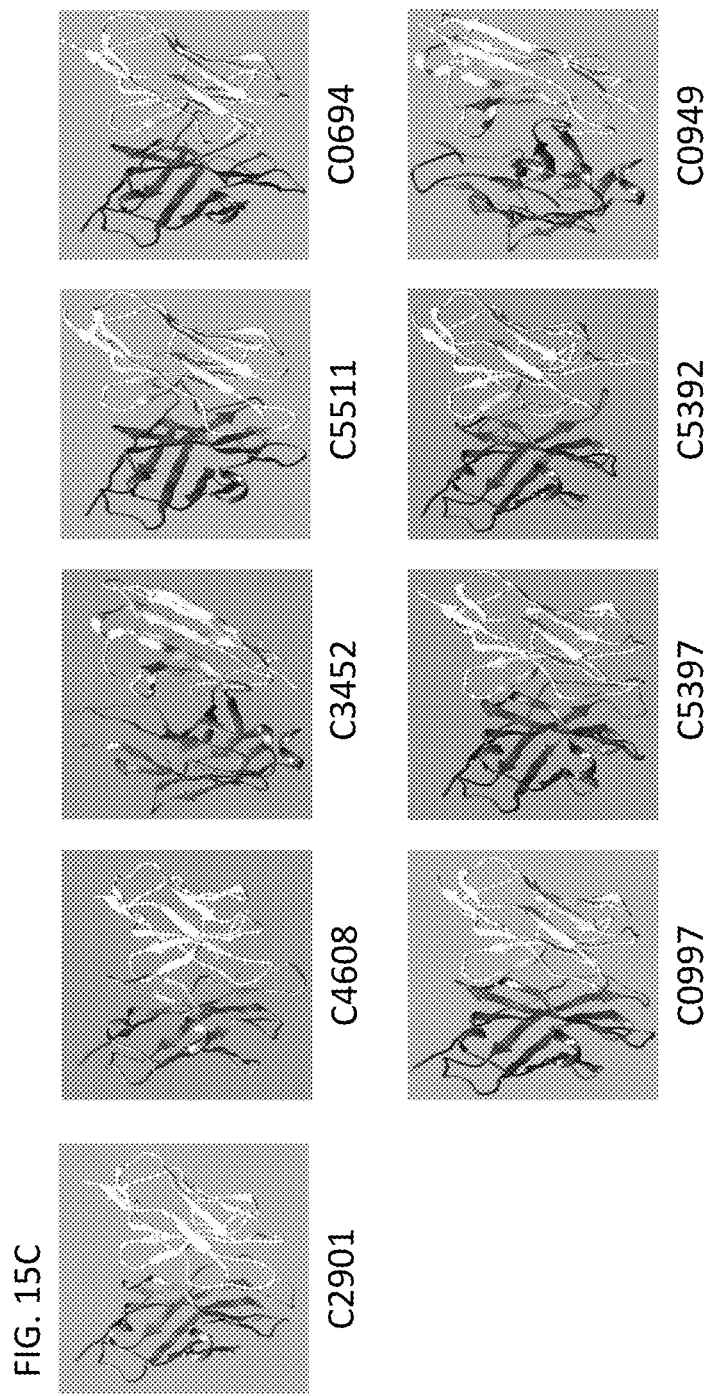
Figure 15D:
Figure 15E:
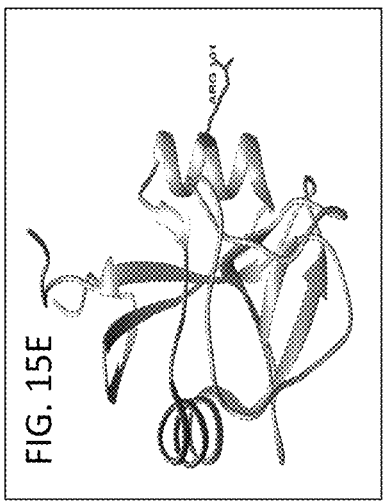
Figure 15F:
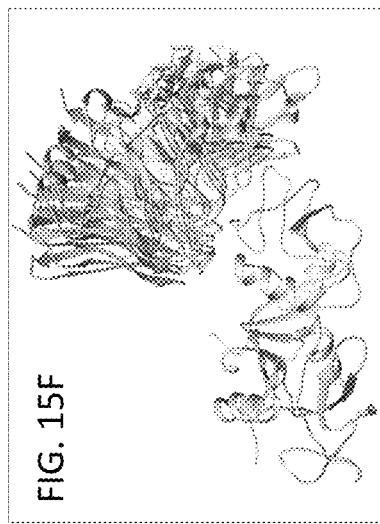
Figure 15G:
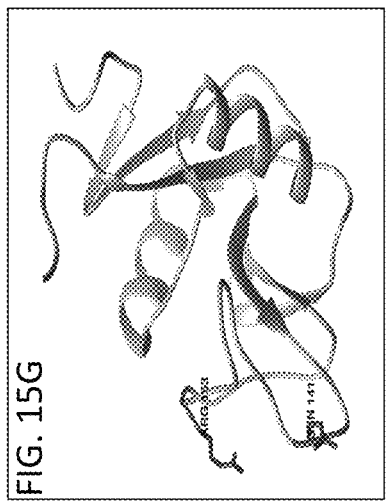

Models of the fourteen antibodies were generated through the use of homology modelling program MODELLER. The models generated were limited to the variable regions of the antibody, as that is the main area of interest. The PDB was parsed for structures of complete variable regions of antibodies. Each of the unique antibody variable region sequences were aligned against the available structures' sequences and the best match for each antibody sequence, was used as the template from which the antibody model was built. Multiple models were generated for each sequence and the most energy efficient structure was selected as the main model for the antibody (FIG. 15C).

Antibodies are very well conserved outside their hypervariable Complementarity Determining Regions (CDR) loops, and of the six CDR on the two chains of the antibody, three on each of the heavy and light chains, the CDR3 loop on the heavy chain is known to be the largest and most influential in the establishment of interactions, and this region along with the light chain CDR3, were run through several rounds of MODELLER's Loop Refinement to generate the most energy efficient structures, with respect to the CDR loops. Once again multiple variants of the main model were generated and the most energy efficient one was taken forward as the refined antibody model.

Docking the Antibody on the CLEC2D

The CLEC2D model was acquired from the PDB, deposited as 4QKI a dimer of CLEC2D chains. As the precise location of the interaction is not known, Molecular Docking was used to generate structures of the complex to explore the possible interaction modes. The program used was Patch-Dock, a shape complementarity docking program which permutes all possible interaction modes based on structural feasibility. (Schneidman-Duhovny et al, 2005)

Docking was carried out between the refined Antibody Variable region structures and the antigen CLEC2D (PDB: 4QKI), using PatchDock's High Accuracy Mode at a cluster distance of 4 Å (preventing conformations within 4 Å of existing conformations from being generated). Constraints were only provided for the antigen structure, wherein both CDR3 loops from the light and heavy chains were specified.

PatchDock generated several docking conformations against each of the provided antibodies. (See Table 29).

TABLE 29

The number of output structures for each Docking of the unique anti-CLEC2D antibody refined structures against CLEC2D.

| Refined Structure | Conformations Generated |
|---|---|
| 1 | 6424 |
| 2 | 17370 |
| 3 | 7338 |
| 4 | 9245 |
| 5 | 17976 |
| 6 | 17170 |
| 7 | 20617 |
| 8 | 5750 |
| 9 | 18198 |
| 10 | 7604 |
| 11 | 10267 |
| 12 | 12699 |
| 13 | 15655 |
| 14 | 6219 |

Analysing Conformations

Following the generation of the docked conformations, their interacting residues were analysed.

In house scripts were used to query the complex structure and identify all residue pairs involving participants from different chains, at a maximum distance of 4Å from one another. These residue pairs were compiled into lists, Table 30 and 31 show such a few lines from such lists, which were then used to cluster the conformations.

TABLE 30

A selection of residue pairs from the contact list generated for C4608 complex 11712. Pairs denoted in single underline, double underline and dashed underline denote pairs across the antigen- antibody chains. The single underlined pairs are those between the antibody-antigen chains that involve any of the previously identified significant residues and CDR3 residues from either the antigen or the antibody. The double underlined pairs involve significant residues on the antigen and non-CDR3 residues on the antibody and dashed underlined pairs involve significant residues from the antigen as well as CDR3 residues on the antibody.

| | |
|---|---|
| 92:ASP:B 94:TRP:C | 101:ARG:B 211:MET:D |
| 92:ASP:B 95:PRO:C | 182:TRP:B 93:THR:C |
| 92:ASP:B 94:TRP:C | 106:GLN:B 28:SER:C |
| 94:LYS:B 95:PRO:C | 78:SER:B 27:GLN:C |
| 105:SER:B 214:PRO:D | 102:PHE:B 28:SER:C |
| 101:ARG:B 214:PRO:D | 102:PHE:B 93:THR:C |
| 105:SER:B 32:SER:C | 106:GLN:B 32:SER:C |
| 77:GLU:B 25:ALA:C | 105:SER:B 30:GLY:C |
| 77:GLU:B 26:SER:C | 77:GLU:B 69:THR:C |
| 106:GLN:B 29:VAL:C | 79:TRP:B 28:SER:C |
| 94:LYS:B 94:TRP:C | 88:TYR:B 27:GLN:C |
| 98:SER:B 93:THR:C | 107:ASP:B 31:ASN:C |
| 106:GLN:B 30:GLY:C | 77:GLU:B 27:GLN:C |
| 88:TYR:B 94:TRP:C | 105:SER:B 29:VAL:C |
| 94:LYS:B 93:THR:C | 105:SER:B 31:ASN:C |

TABLE 31

A selection of residue pairs from the contact list generated for C5511 complex 14228. Pairs denoted in single underline, double underline and dashed underline denote pairs across the antigen-antibody chains. The single underlined pairs are those between the antibody-antigen chains that involve any of the previously identified significant residues and CDR3 residues from either the antigen or the antibody. The double underlined pairs involve significant residues on the antigen and non-CDR3 residues on the antibody and dashed underlined pairs involve significant residues from the antigen as well as CDR3 residues on the antibody.

| | |
|---|---|
| 128:PRO:B 219:LEU:D | 165:TYR:B 223:TRP:D |
| 128:PRO:B 220:PHE:D | 167:ASN:B 110:GLU:D |
| 129:SER:B 219:LEU:D | 168:ASP:B 110:GLU:D |
| 129:SER:B 220:PHE:D | 169:LYS:B 110:GLU:D |
| 130:ASP:B 220:PHE:D | 175:ARG:B 225:GLN:D |
| 127:GLY:B 219:LEU:D | 179:GLU:B 42:GLN:C |
| 130:ASP:B 223:TRP:D | 179:GLU:B 40:PRO:C |
| 165:TYR:B 112:GLN:D | 180:ARG:B 223:TRP:D |

Clustering Conformations and Assessing Viability

Conformations were clustered on the basis of overlapping contacts, conformations were clustered together if at least 75% of the residue pairs were in common. Conformations that were not incorporated into a cluster were discarded.

Of the remaining structures, energy minimization was carried out on all the complexes before the next filtration step where the Protein Interaction Z Score Assessment (PIZ SA) tool was used to filter out non-binder conformations. PIZSA took in the protein complexes and identified all the likely residue interactions on the basis of a distance threshold applied to the residues' atoms. Following identification it evaluated every contact pair and scored the constituent associations, building up a cumulative score which was ultimately used to determine if the associations it has identified would lead to stable association, if the complex is viable, or not. (Roy et al, 2019) (This viability is based on the composition and combinations of the identified contact pairs.) Conformations identified as viable were the only ones retained. (See Table 32).

TABLE 32

The Total numbers and membership data of clusters identified when clustering was carried out for 75% identify of interactions. The final column lists the number of conformations that are recognised as PIZSA as being viable.

| Antibody | Total Clusters | Total Conformations | Viable Conformations |
|---|---|---|---|
| C2901 | 13 | 100 | 69 |
| C4608 | 19 | 138 | 117 |
| C3452 | 6 | 30 | 9 |
| C5511 | 7 | 44 | 39 |
| C0694 | 4 | 29 | 9 |
| C0997 | 6 | 44 | 37 |
| C5397 | 3 | 21 | 21 |
| C5392 | 7 | 47 | 36 |
| C0949 | 6 | 43 | 42 |

These reduced clusters were composed of several tightly grouped structures, all of which formed overlapping associations with the CLEC2D chain.

These cluster formations were taken as likely binding site positions and the validation of each site needed to be carried out (FIGS. 15D, 15E, 15F, and 15G).

Mutation Analysis

Following the short-listing of a smaller number of viable structures to explore, mutation analysis was carried out. PIZSA also had a feature whereby it takes identified contact pair and substitutes each participant residue with the other 19 natural amino acids and determined the impact on the overall score of the structure for that substitution. The impact value would be indicative of the loss of stability the complex would experience if a specific residue was swapped out for another. Residues that were important for the complex, which form strong associations would have high impact values, as mutating those positions could weaken or destabilise the complex. This information was used to identify which residue pairs mutations would be the most destabilizing to the overall complex. As the conformations were already clustered, an entire cluster could be evaluated by around identifying three to four high impact residue-pairs that were prevalent in all members of the clusters, for mutation. Herein significant considerations were made based on following parameters, such as, Same Cluster Count indicating the total number of times a specific residue was observed in an interaction within same cluster on the same antibody; Same_Cluster_Proportionate indicating proportionate number of times a specific residue was observed in an interaction within same cluster on the same antibody; Same antibody in Other Cluster occurrence count meaning the total number of times a specific residue was observed in an interaction among all clusters on the same antibody that can be seen multiple times in the same cluster; Same antibody Other Cluster count describes the total number of structures in which a specific residue was observed in an interaction among all clusters on the same antibody capturing multiple instances in the same cluster however only counted once; Other antibody Other Cluster occurrence count describes as the total number of times a specific residue was observed in an interaction among all clusters on the other antibodies; Other antibody other Cluster count indicating the total number of structures in which a specific residue was observed in an interaction among all clusters on other antibodies (multiple instances in the same cluster only counted once). Taking together, this approach in turn provided the epitope patch on CLEC2D antigen against respective anti-CLEC2D antibody. The similar method was justifiably adopted for all anti-CLEC2D antibodies as well.

TABLE 33 summarizes on significant residues on CLEC2D antigen contacting C4608 anti-CLEC2D antibody

| Clone No. | Cluster No. | Residue | Position | Same Cluster Count | Same Cluster Proportionate | Same Ab Other Cluster occurrence count | Same Ab Other Cluster count | Other Ab Other Cluster occurrence count | Other Ab Other Cluster count | CD161 overlap |
|---|---|---|---|---|---|---|---|---|---|---|
| C4608 | G00001 | ARG | 101 | 10 | 100 | 26 | 4 | 100 | 22 | No |
|  | G00001 | SER | 105 | 6 | 100 | 15 | 4 | 36 | 11 | No |
|  | G00004 | ASP | 104 | 8 | 100 | 7 | 3 | 26 | 8 | No |
|  | G00007 | PHE | 102 | 3 | 100 | 13 | 4 | 27 | 12 | No |
|  | G00007 | SER | 98 | 1 | 100 | 10 | 5 | 37 | 19 | No |
|  | G00007 | SER | 105 | 6 | 100 | 15 | 4 | 36 | 11 | No |
|  | G00008 | TYR | 177 | 7 | 100 | 10 | 1 | 145 | 25 | Yes |
|  | G00008 | GLU | 179 | 5 | 100 | 14 | 3 | 129 | 20 | Yes |
|  | G00009 | GLU | 138 | 5 | 100 | 7 | 4 | 66 | 20 | No |
|  | G00009 | GLN | 141 | 10 | 100 | 21 | 5 | 82 | 17 | No |
|  | G00010 | PHE | 102 | 7 | 100 | 0 | 0 | 14 | 8 | No |
|  | G00010 | ARG | 101 | 13 | 100 | 2 | 2 | 82 | 17 | No |
|  | G00011 | THR | 152 | 3 | 100 | 10 | 2 | 67 | 21 | No |
|  | G00011 | ARG | 153 | 12 | 100 | 12 | 2 | 159 | 25 | No |
|  | G00011 | GLN | 154 | 5 | 100 | 9 | 2 | 72 | 16 | No |
|  | G00011 | PRO | 156 | 3 | 100 | 1 | 1 | 53 | 16 | No |
|  | G00011 | GLN | 117 | 4 | 100 | 4 | 2 | 44 | 13 | No |
|  | G00012 | THR | 152 | 5 | 100 | 8 | 2 | 67 | 21 | No |
|  | G00012 | GLU | 150 | 7 | 100 | 8 | 2 | 96 | 21 | No |
|  | G00014 | THR | 152 | 5 | 100 | 8 | 2 | 67 | 21 | No |
|  | G00014 | GLU | 150 | 3 | 100 | 12 | 2 | 96 | 21 | No |
|  | G00014 | ARG | 153 | 4 | 100 | 20 | 2 | 159 | 25 | No |
|  | G00015 | PHE | 102 | 3 | 100 | 13 | 4 | 27 | 12 | No |
|  | G00016 | TRP | 151 | 1 | 100 | 4 | 3 | 18 | 10 | No |
|  | G00016 | GLU | 150 | 6 | 100 | 24 | 5 | 59 | 13 | No |
|  | G00016 | THR | 149 | 3 | 100 | 12 | 3 | 38 | 10 | No |
|  | G00016 | ARG | 153 | 5 | 100 | 28 | 5 | 60 | 11 | No |
|  | G00016 | GLY | 140 | 2 | 100 | 19 | 6 | 62 | 19 | No |
|  | G00016 | GLN | 141 | 5 | 100 | 26 | 5 | 82 | 17 | No |
|  | G00017 | GLN | 141 | 4 | 100 | 27 | 5 | 82 | 17 | No |
|  | G00017 | PRO | 142 | 2 | 100 | 16 | 5 | 32 | 14 | No |
|  | G00017 | ARG | 153 | 5 | 100 | 28 | 5 | 60 | 11 | No |
|  | G00017 | GLU | 150 | 4 | 100 | 26 | 5 | 59 | 13 | No |
|  | G00017 | THR | 152 | 4 | 100 | 16 | 4 | 34 | 10 | No |
|  | G00018 | PRO | 156 | 4 | 100 | 2 | 1 | 14 | 6 | No |
|  | G00018 | LEU | 158 | 3 | 100 | 0 | 0 | 14 | 8 | No |
|  | G00018 | ARG | 153 | 7 | 100 | 26 | 5 | 60 | 11 | No |
|  | G00018 | PHE | 155 | 2 | 100 | 3 | 2 | 11 | 5 | No |
|  | G00018 | LYS | 169 | 4 | 100 | 4 | 1 | 6 | 5 | Yes |
|  | G00020 | ARG | 137 | 1 | 100 | 6 | 5 | 26 | 16 | No |
|  | G00020 | TYR | 177 | 6 | 100 | 27 | 4 | 158 | 24 | Yes |
|  | G00020 | GLU | 162 | 3 | 100 | 6 | 2 | 49 | 18 | Yes |
|  | G00020 | ALA | 160 | 2 | 100 | 10 | 4 | 44 | 19 | Yes |
|  | G00020 | ARG | 175 | 4 | 100 | 18 | 3 | 90 | 21 | Yes |
|  | G00020 | GLN | 139 | 5 | 100 | 15 | 7 | 77 | 21 | Yes |
|  | G00020 | TRP | 96 | 1 | 100 | 1 | 1 | 9 | 8 | No |
|  | G00020 | GLU | 138 | 4 | 100 | 8 | 4 | 66 | 20 | No |
|  | G00020 | ARG | 101 | 1 | 100 | 14 | 2 | 82 | 17 | No |
|  | G00020 | SER | 136 | 2 | 100 | 2 | 1 | 7 | 7 | No |
|  | G00020 | GLY | 140 | 2 | 100 | 19 | 6 | 62 | 19 | No |
|  | G00021 | GLU | 150 | 9 | 100 | 21 | 5 | 59 | 13 | No |
|  | G00021 | THR | 149 | 4 | 100 | 11 | 3 | 38 | 10 | No |
|  | G00022 | THR | 93 | 5 | 100 | 9 | 3 | 64 | 20 | No |
|  | G00022 | TYR | 177 | 10 | 100 | 7 | 1 | 145 | 25 | Yes |
|  | G00022 | GLU | 179 | 10 | 100 | 9 | 3 | 129 | 20 | Yes |
|  | G00026 | TRP | 151 | 1 | 100 | 4 | 3 | 18 | 10 | No |
|  | G00026 | GLU | 150 | 5 | 100 | 25 | 5 | 59 | 13 | No |
|  | G00026 | ARG | 153 | 8 | 100 | 25 | 5 | 60 | 11 | No |
|  | G00026 | GLN | 154 | 3 | 100 | 13 | 4 | 25 | 5 | No |
|  | G00026 | THR | 152 | 6 | 100 | 14 | 4 | 34 | 10 | No |
|  | G00031 | THR | 178 | 4 | 100 | 7 | 1 | 55 | 20 | Yes |
|  | G00031 | GLU | 179 | 3 | 100 | 19 | 3 | 92 | 19 | Yes |
|  | G00031 | TYR | 177 | 8 | 100 | 25 | 4 | 158 | 24 | Yes |
|  | G00031 | ARG | 175 | 5 | 100 | 17 | 3 | 90 | 21 | Yes |

In order to identify which of the clusters describe the true binding sites, a series of mutations would be suggested to key residues. Due to the high number of clusters it was advantageous to identify mutations which were capable of testing multiple clusters concurrently. All the residues identified for all the clusters of a single antibody were analysed to achieve this. The idea was that multiple clusters would be put into combinations and residues that play a major role in all of their potential binding modes be suggested as mutations to concurrently test many conformations. These combinations were identified by inspecting the overlapping significantly involved residues (those occurring in the top 3 proportions of each cluster.) If clusters shared multiple significantly involved residues they were taken as possible combinations. As exemplified herein, mutations were suggested for C4608 and C5511. These antibodies had 21 and 7 clusters respectively, in order to cluster these, the represented residues from all these clusters were analysed. An inspection of the representative overlaps of significantly occurring residues suggested possible combinations of G00001-G00004-G00007-G00010-G00015, G00012-G00014-G00016-G00017-G00018-G00021-G00026, G00005-G00008-G00020-G00022-G00031 and G00011-G00012-G00014-G00018 for C4608 and possible combinations of G00001-G00005-G00011-G00019-G00020 with G00015 and G00017 by themselves for C5511. Strategy described above was adapted for all anti-CLEC2D antibodies.

To identify which residues played a role in combinations of clusters every possible combination of lengths varying from 2 to 13 cluster (depending on the total number of initial clusters available) were generated. For every combination, all the involved residues along with their impact values were identified. Residues that were involved in all or a majority (at most missing in two members) of the members of the combination were retained while the residues that only played a role in some of the clusters in the combination were removed from consideration, leaving only a list of highly occurring residues.

Figure 16A:
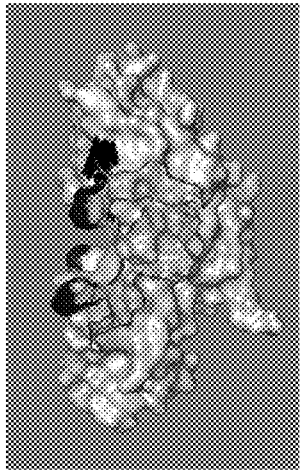
FIGS. 16A-16G illustrate on identified epitope patch on CLEC2D antigen against anti-CLEC2D antibody clones C4608 and C5511.
Figure 16C:
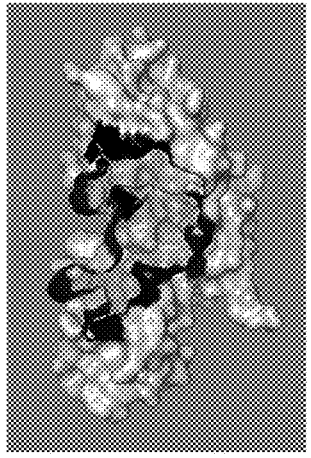
Figure 16B:
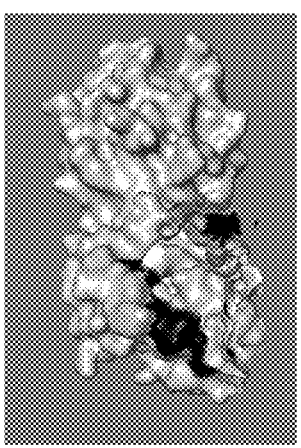
Figure 16D:
Figure 16E:
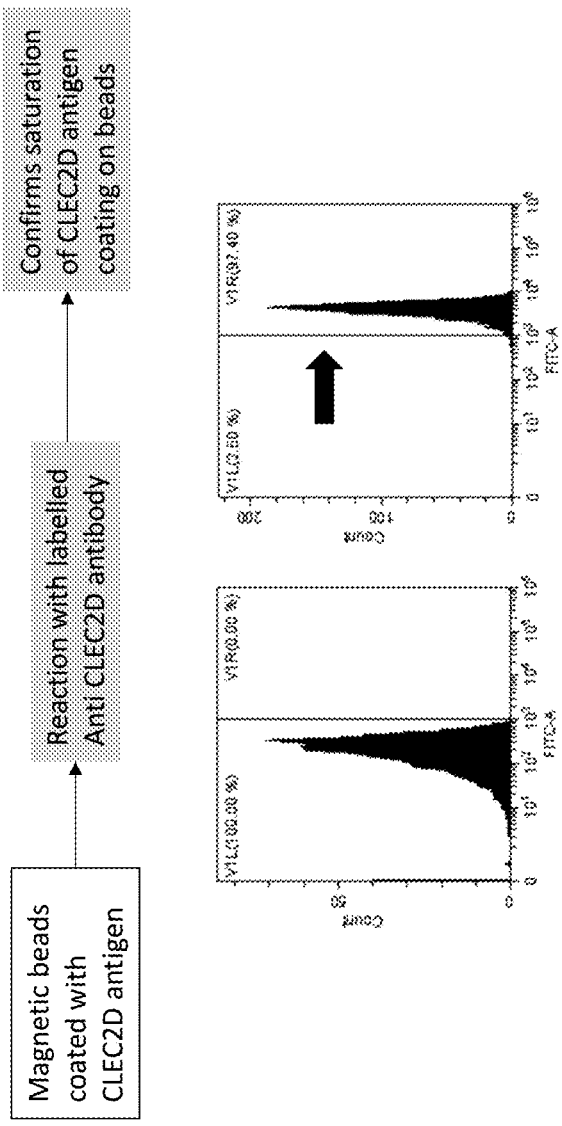
Figure 16F:
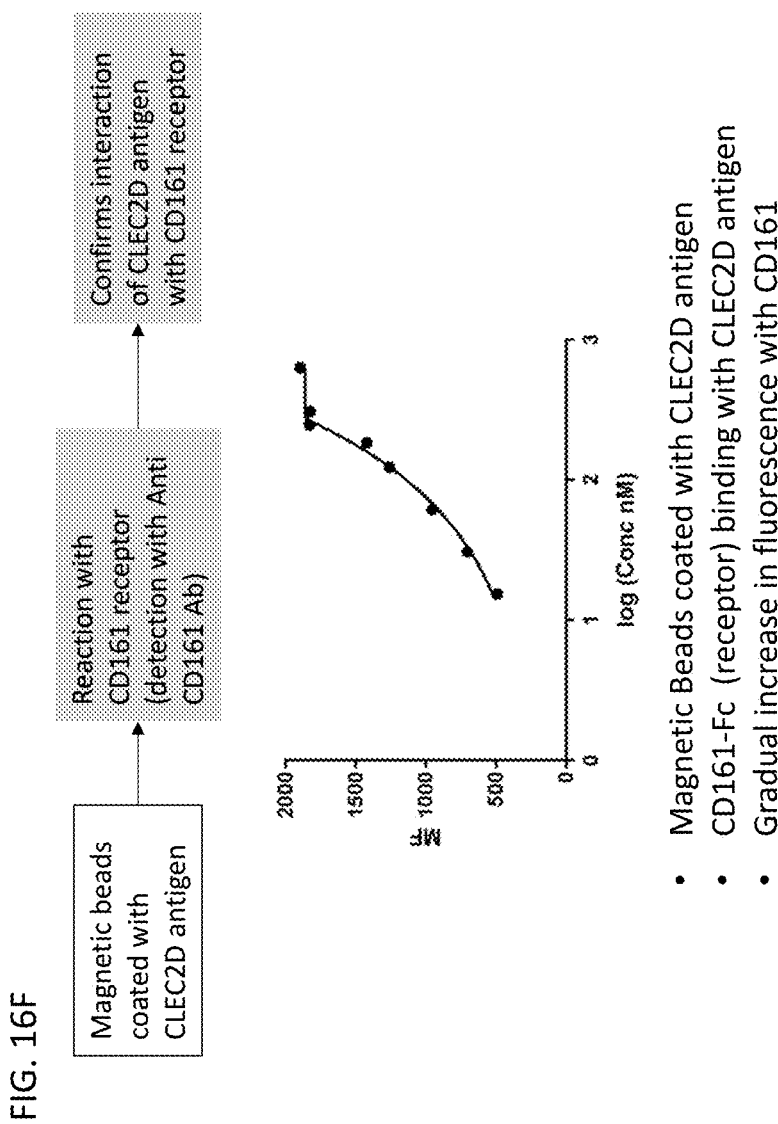
Figure 16G:
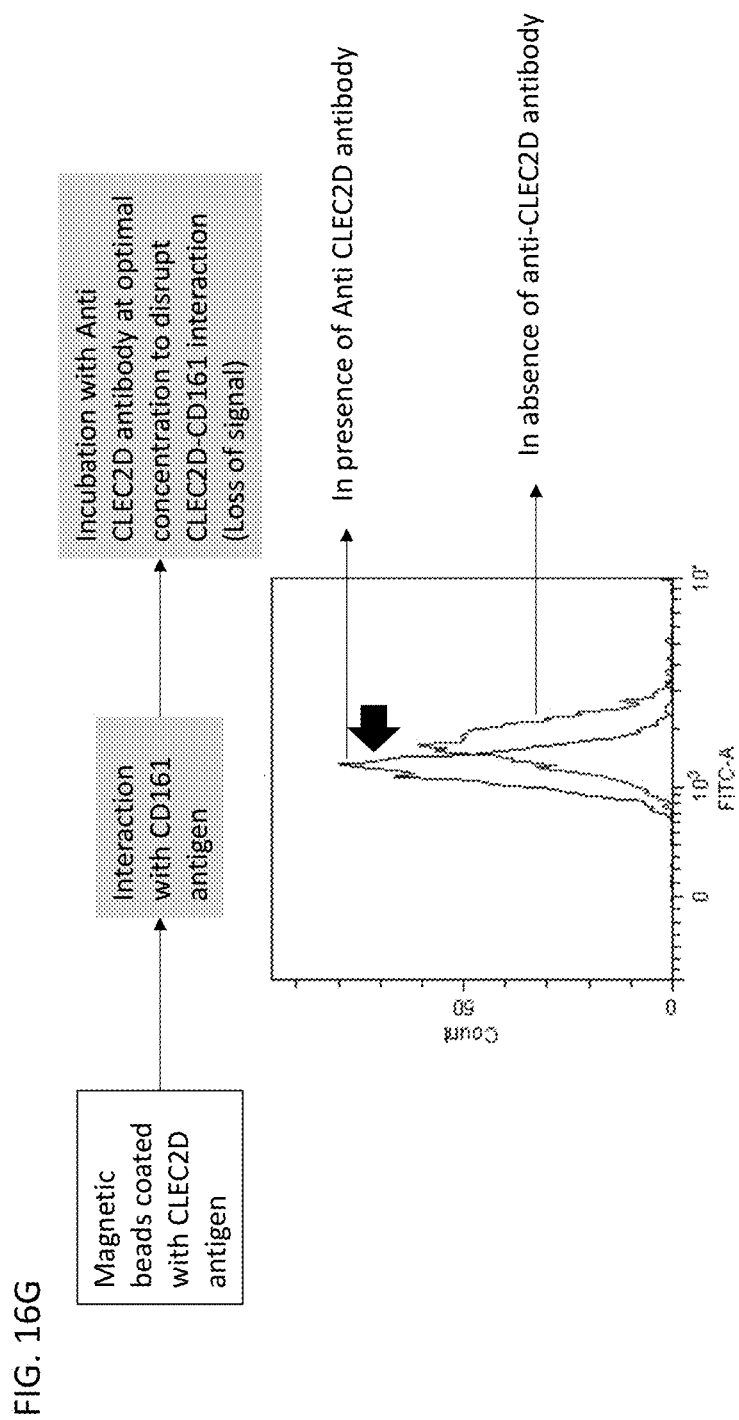

Once a preferable combination was identified based on the overlap of residues the residues that were highly occurring for that combination were scrutinized and residues that were observed to have a high impact value were put forward as mutation options (FIGS. 16E and 16G).

The picks made after all those considerations would possess all the following properties, (a) Be charged or polar residues (although if no such residues were observed other were selected based on their impact on the interaction.), (b) Be present in all or most of the clusters of a combination, (c) Have a significant on the potential binding mode, and (d) involve the antigen-interacting residues As exemplified by C4608, wherein the above described strategy was adopted and following combinations of residues are believed to be involved in interaction with CLEC2D antigen. The similar method was justifiably adopted for all anti-CLEC2D antibodies as well.

TABLE 34

The final set of selections of the combinations identified for Antibody clone C4608

| Clone Number | Clusters | Remaining Clusters | Residue position | Average Impact | Impact | Present on all Clusters | Unique to clusters |
|---|---|---|---|---|---|---|---|
| C4608 | G00001 | G00005 | 101:ARG:A | −1092.6 | yes | yes | no |
|  | G00004 | G00008 |  |  |  |  |  |
|  | G00007 | G00011 |  |  |  |  |  |
|  | G00010 | G00012 |  |  |  |  |  |
|  | G00015 | G00014 |  |  |  |  |  |
|  |  | G00016 |  |  |  |  |  |
|  |  | G00017 |  |  |  |  |  |
|  |  | G00018 |  |  |  |  |  |
|  |  | G00020 |  |  |  |  |  |
|  |  | G00021 |  |  |  |  |  |
|  |  | G00022 |  |  |  |  |  |
|  |  | G00026 |  |  |  |  |  |
|  |  | G00031 |  |  |  |  |  |
|  | G00012 | G00005 | 150:GLU:A | −382.44 | no | yes | no |
|  | G00014 | G00008 | 154:GLN:A | −379.74 | no | yes | no |
|  | G00016 | G00011 |  |  |  |  |  |
|  | G00017 | G00020 |  |  |  |  |  |
|  | G00018 | G00022 |  |  |  |  |  |
|  | G00021 | G00031 |  |  |  |  |  |
|  | G00026 |  |  |  |  |  |  |
|  | G00005 | G00011 | 175:ARG:A | −710.34 | yes | yes | no |
|  | G00008 |  | 177:TYR:A | −1056.29 | yes | yes | no |
|  | G00020 |  | 179:GLU:A | −612.15 | yes | yes | no |
|  | G00011 | — | 150:GLU:A | −544.91 | yes | yes | no |
|  | G00012 |  | 152:THR:A | −577.26 | yes | yes | no |
|  | G00014 |  | 153:ARG:A | −649.57 | yes | yes | no |
|  | G00018 |  | 154:GLN:A | −568.9 | yes | yes | no |

Construct Generation as Soluble CLEC2D Variants

Once the amino acids, which are in combination or independently, are either overlapping or non-overlapping with CD161 interaction points, were generated as CLEC2D antigen variants to map the epitope for novel anti-CLEC2D antibody clones. The constructs were generated either by site directed mutagenesis or by gene synthesis. All constructs were having C-term histidine tag, similar to soluble CLEC2D antigen used for screening, to facilitate the further purification. All possible positions were changed into amino acid alanine, as the observed in silico mutation impact was seen to be maximum for the said amino acid. Table 35 describes positions in CLEC2D soluble antigen wherein the mutations were introduced.

TABLE 35

| Positions for mutation |
|---|
| P128A |
| S129A |
| D130A |
| Q139A |
| E162A |
| Y165A |

TABLE 35-continued

Positions for mutation

K169A
S173A
R175A
Y177A
T178A
E179A
R180A
K181A
K169A & S172A
Y165A & N167A
R101A
Q141A
R153A
S187A
H190A
R175A, Y177A, E179A
R084A, H190A
E150A, T152A, R153A, Q154A
R101A, S105A, D107A, H190A
Q141A, R153A
D092A, T093A, K094A
Q141A, K144A
E138A, C176A
E138A, Q139A, Q141A, R175A
D092A, Y177A, K181A
F116A, R153A,
T093A, N095A
T093A, Y177A, E179A
K094A, R101A, E179A
R175A, Y177A, R180A

As exemplified herein, site directed mutagenesis was performed using QuikChange Lightning Site-Directed Mutagenesis Kit from Agilent by PCR using synthesizing two complimentary oligonucleotides containing the desired mutation, flanked by unmodified nucleotide sequence, which were synthesized at Eurofins. PCR was performed on an Eppendorf™ Mastercycler™ pro PCR System in 25-µL volumes consisting of 0.2 µM of each primer (Eurofins, India), 1.5 µL of Quick solution, 1 µL Quickchange XL dNTP mix, 10× quick change lightening buffer 2.5 µL. Also included were template DNA 15 ng. Following an initial denaturation at 95° C. for 2 min, 18 cycles of 20 seconds denaturation at 95° C., and 60 seconds annealing at 60° C., 3 minutes primer extension at 68° C., 5 minutes final extension at 68° C. were performed. After PCR 2 µL of Dpn I endonuclease was added which is specific for methylated and hemimethylated DNA and is used to digest the parental DNA template and to select for mutation-containing synthesized DNA (DNA isolated from almost all E. coli strains is dam methylated and therefore susceptible to Dpn I digestion.) The nicked vector DNA containing the desired mutations was then transformed into XL10-Gold ultracompetent cells and plated onto ampicillin-containing LB agar plates. Plasmid DNA from transformed colonies was purified by QIAprep Spin Miniprep kit (Qiagen) and sequenced at Eurofins.

Vector and the SDM construct having specific mutation were restriction endonuclease activity with HindIII and XhoI enzymes and product was extracted using QIAquick Gel Extraction kit, ligated using T4 DNA ligase (NEB) and 50% of mixture were transformed into NEB5α competent cells E. coli. Subsequently clone screening was carried out through restriction digestion and finally through sequencing reaction. Sequencing process confirmed the clones to contain desired mutation.

Anti-CLEC2D antibody mediated blocking of CLEC2D and CD161 interaction. Further probing into observations made from epitope mapping studies prompted to the fact that anti-CLEC2D antibody binding sites on CLEC2D antigen comprises of contact points having both unique/exclusive contact points established on CLEC2D antigen and binding sites overlapping with contact points established between CLEC2D-CD161 complex. As exemplified herein, epitope patches on CLEC2D antigen for C4608 (FIG. 16A and FIG. 16B) and C5511 (FIG. 16C and FIG. 16D), not limited to, has been represented wherein binding sites for both C4608 and C5511 anti-CLEC2D antibodies interacting with CLEC2D antigen overlaps significantly with contact points between CLEC2D antigen and CD161. Present disclosure explores the impact of identified anti-CLEC2D antibody on the interaction between CLEC2D and CD161 proteins. As tumour cell evades immune system through the said interaction between CLEC2D and CD161, therefore, experimental validation of CLEC2D binder i.e., anti-CLEC2D antibody disrupting the interaction has been further proved below. Experimental details starts with confirmation of CLEC2D and CD161 interaction followed by abrogating the same by the use of anti-CLEC2D antibody.

As exemplified herein, CLEC2D antigen was conjugated on magnetic beads wherein, 1 ml of 0.1 M phosphate buffer saline was added in to 0.5 mg Dynabeads and vortexed for 30 seconds followed by incubation at rotation, at RT for 10 minutes. After incubation, beads were washed twice with 1 ml of 0.1 M phosphate buffer saline with the help of Dynamag 2, then washed beads were resuspended in to 100 µl of 0.1 M PBS. To conjugate antigen on magnetic beads, 100 µl of washed beads and 100 µl PBS containing 1 µg of CLEC2D antigen were mixed thoroughly in the presence of 100 µl of 3 M ammonium sulphate then incubated at 37° C. for overnight. Overnight incubated mix was washed twice with PBS and blocked with 100 µl PBS containing 0.5% BSA for 2 hrs followed by separation of magnetic beads with Dynamag 2.

Finally conjugated antigen beads were resuspended in to 100 µl PBS. To check the identity of antigen, 1 µl of above conjugated antigen bead was resuspended in to 99 µl of 1×PBS and washed once with 0.1 M PBS and again resuspended in to 100 µl of 1×PBS. 0.5 µg of anti-CLEC2D monoclonal antibody, commercially available from Novus Biologicals was added in to 100 µl washed conjugated antigen beads then incubated on ice for 2 hrs with constant tapping. After incubation, conjugated antigen beads were washed twice with 100 µl of 1×PBS containing 0.25% BSA then 100 µl of 5 µg/ml Alexa Fluor 488 goat anti-mouse IgG (H+L) was added in to conjugated antigen beads and further incubated for 30 min on ice. After incubation, conjugated antigen beads were washed twice with 100 µl of 1×PBS containing 0.25% BSA and resuspended in to 200 µl of 1×PBS. Fluorescence of all samples including controls were read through CytoFLEX. Bead conjugation efficiency was found to be >95% as judged by flow cytometry analysis as depicted in (FIG. 16E).

To check the binding of CD161-Fc with CLEC2D antigen, 2 µl of above conjugated CLEC2D antigen beads was taken and different concentrations of CD161-FC (purchased from Biolegend) was added and incubated on ice for 2 hrs with constant tapping to avoid settling of beads. After incubation, the beads was washed twice with 100 µl of PBS with 1% BSA. 100 µl of 5 µg/ml of alexa fluor goat anti human IgG, was added and incubated on ice for 20 min on rotation. The beads was washed once with 100 µl of PBS with 1% BSA and resuspended with 100 µl of 1×PBS.

Fluorescence of all samples including controls was read through CytoFLEX. As can be seen from FIG. 16F, CLEC2D antigen conjugated on magnetic beads interacts in a dose dependent manner to CD161 protein.

0.5 μg biotinylayted CD161-FC was added in to 2 μl of CLEC2D conjugated beads and incubated on ice for 2 hrs. After incubation the beads were washed twice with 100 μl of PBS containing 1% BSA and 200 ng of Streptavidin, Alexa Fluor™ 633 conjugate was added and further incubated on ice for 20 min. After incubation the beads were washed twice with 100 μl PBS containing 1% BSA and 2 μg of C5511 antibody was added for 2 hrs on ice. After 2 hrs incubation, 5 μg/ml of alexa fluor goat anti human IgG was added and further kept for 20 min on ice with rotation. Finally fluorescence of all samples including controls were read through CytoFLEX. Loss of signal CLEC2D-CD161 interaction at optimal concentration of anti-CLEC2D antibody as seen in FIG. 16G, indicates that anti-CLEC2D antibody can compete with CLEC2D-CD161 contact sites and disrupt the interaction.

Immune Cell Activation: Due to Binding of Anti-CLEC2D Antibody

The prevailing view of NK cell activation is their ability to distinguish healthy cells from sensitive target cells through a balance between signals from activating and inhibitory receptors. The net output of major positive and negative signalling events is viewed to determine the capacity of NK cells to kill target cells. However, the precise molecular check-points where inhibitory signals abrogate activating pathways are not well defined.

However, attempts towards delineating the contribution of individual receptors to NK cell activation, CD 69 surface receptor was considered as an early activation immune cells marker which gets rapidly induced in NK cells shortly after activation. CD69 promoter contains binding site for NF-κB, erythroblast transformation-specific related gene-1 (ERG-1) and AP-1. Its expression is upregulated upon activation in most leukocytes and use as a marker of activated lymphocytes and NK cells. In addition CD69 is also an important regulator of immune responses. CD69 is involved in NK-cells activation via Syk-Src-dependent manner. Whereas in T-cells CD69 is induced after TCR/CD3 engagement where it negatively regulates TH1/TH17 response and control inflammation in vivo also through TGF-B signaling. However in NK cells CD69 cross linking has been shown to induce cytotoxic activity and cytokines production of activated NK cells. Thereby, CD69 can be represented as a putative receptor for target cells in activated NK cells. Effector cells used in this study, PBMC and NK cells, as applicable, were isolated using protocol as described above.

In order to understand the impact of Anti-CLEC2D antibody on NK cell status, level of CD69 marker expression on NK cells were monitored in the presence and absence of Anti-CLEC2D antibody. For each reaction $0.1 \times 10^6$ of isolated NK cells were taken. IL-2 was used as positive control. 200 U of IL-2 (Acro biosystems) and anti-CLEC2D 100 μg/mL and 200 μg/mL was added to each well and incubated overnight. In order to understand the change in CD69 expression through PC3 priming, PC3 cells were added at 1:1 (T:E) ratio to NK cells with or without anti-CLEC2D antibody C5511. NK cells without any treatment or targets were kept as control. Post 12-16 hrs of incubation, CD markers not limited to, anti human CD3-FITC and anti human CD69-APC750 (Biolegend) staining was done 0.5 uL of respective antibodies were used against $0.1 \times 10^6$ cells. Cells were washed once with 1×PBS 0.2% BSA and reading was taken using CytoFLEX (Beckman Coulter). Data was acquired using default gain settings and 5000-10000 events were recorded per sample.

Figures 17A, 17B:
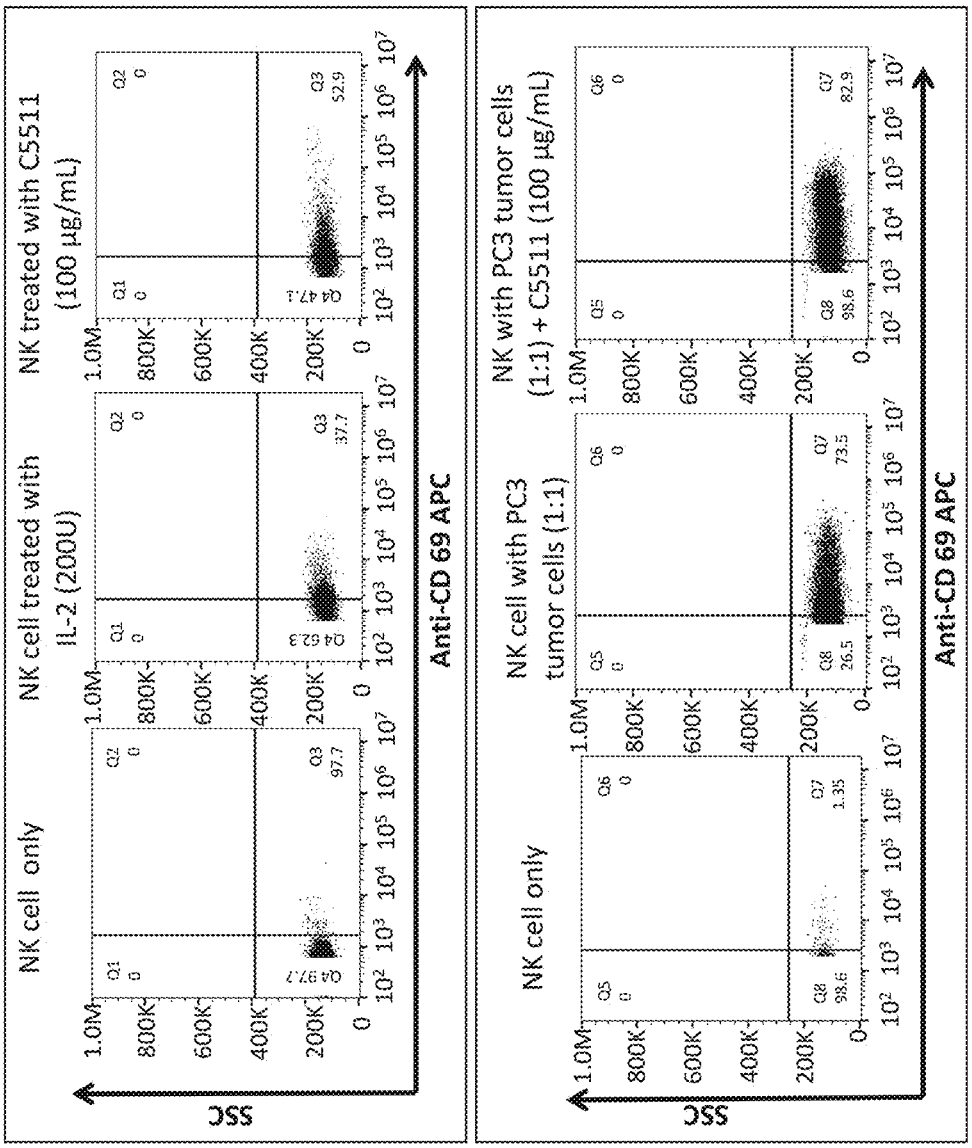

The results showed 40-50% upregulation of CD69 expression as observed in NK cells in presence of C5511 antibody (100 μg/mL and/or 200 μg/mL) when compared to NK control without treatment wherein the baseline expression was recorded to be 1-2% (FIG. 17A). IL-2 was used as positive control and showed 30-40% upregulation (FIG. 17A). In case of tumor (PC3) primed NK cells showed high expression close to 70-75% expression of CD69 while CD69 expression was upregulated to ~85% in presence of both PC3 cell and antibody 100 μg/mL, (FIG. 17B).

Secretion/Intra-Cellular Expression of Cytokine/Chemokines

NK cells recognition of tumor cells/infected cells induces cytotoxicity and cytokines secretion. Signaling pathways which regulates the cytokines production and the contribution of NK cell activation receptor upon target cell recognition for the process is not well understood. In addition the condition/requirement of cytokines secretion on engagement of specific ligand in target cells is not known. Thereby, to understand the primary initiation of immune response upon target cell recognition by NK cells profile/screening of cytokines and chemokines are important. Here, the study was designed to detect cytokine secretion in presence of novel antibody C5511. IFN-γ and TNF-α are the two of the most prominent cytokines produced by NK cells and has been implicated in both cytotoxicity and proliferation of various immune cells. Thereby in this study experiments were conducted to detect IFN-γ secretion in PBMCs or isolated NK-cells by a well-established intracellular IFN-γ staining technique on flow based assay.

Cells Stimulation and IFN-γ Staining Protocol:

After overnight rest of PBMCs and NK cells at 37° C., the activation reagents and secretion inhibitor (Brefeldin A (10 μg/mL)/Monensin (6 μg/mL)) was added to the well. PBMCs and NK cells were left untreated or treated with novel antibody C5511 at 100 μg/mL. Cells were stimulated with anti human OKT-3 (1-2 μg/mL) as a positive control, as it is known to induce IFN-γ secretion. Target cells, at an effector to target ratio of 10:1 was used whenever required. Medium alone served as the negative control. Cells were incubated for 4 hours at 37° C., in CO2 incubator.

After incubation EDTA to a final concentration of 2 mM was added and incubated for 15 min at room temperature. Wash the cells with PBS at 1600 rpm, 8 min at room temperature. PBS wash was repeated at 1600 rpm, 8 min, room temperature and resuspend in 500 μl PBS. Anti-CD3 (Biolegend) cocktail for each sample (20 μl in final) was added. Compensation was done for appropriate amount of single antibodies for compensation controls. Cells were incubated for 30 min at room temperature in the dark. 2 ml of FACS buffer was added to each well tube. Cells were washed twice with FACS buffer at 1600 rpm, 8 min, room temperature. Cells are then re-suspended in 100 μl of flow buffer (0.1% BSA in DPBS) with or 250 μl/tube of BD cytofix/cytoperm, was incubated for 15 min at RT. Cells were then centrifuged at 2000 rpm for 8 min at 4° C. and supernatant was discarded.

Cells were washed twice in wash buffer. Supernatant was discarded and IFN-γ PE (Invitrogen) intracellular staining was done as per manufacturer's protocol. Cells were incubated for 30 min-60 min, on ice, in the dark. After the incubation cells were washed twice with 1 ml of FACS buffer. Supernatant was discarded and resuspend in a final volume of 150 μl FACS buffer for Flow.

Figure 18A:
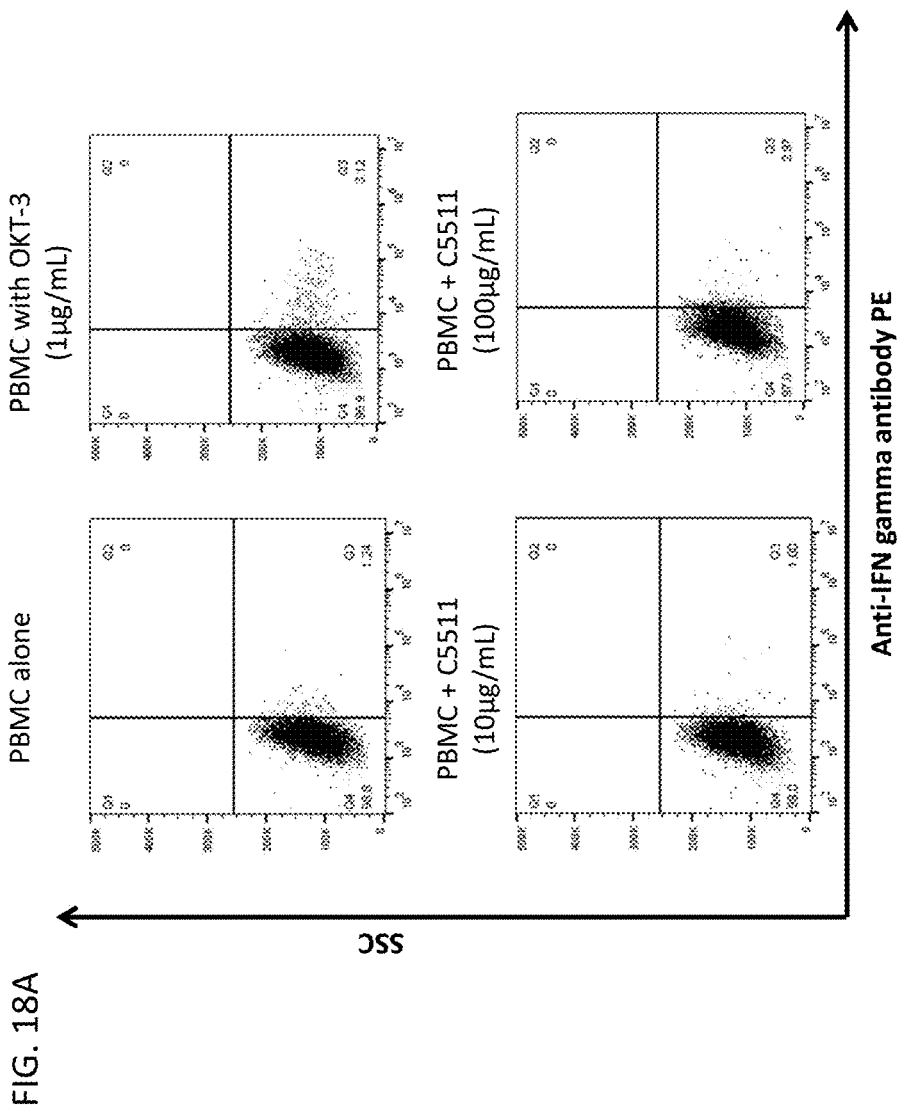
Figure 18B:
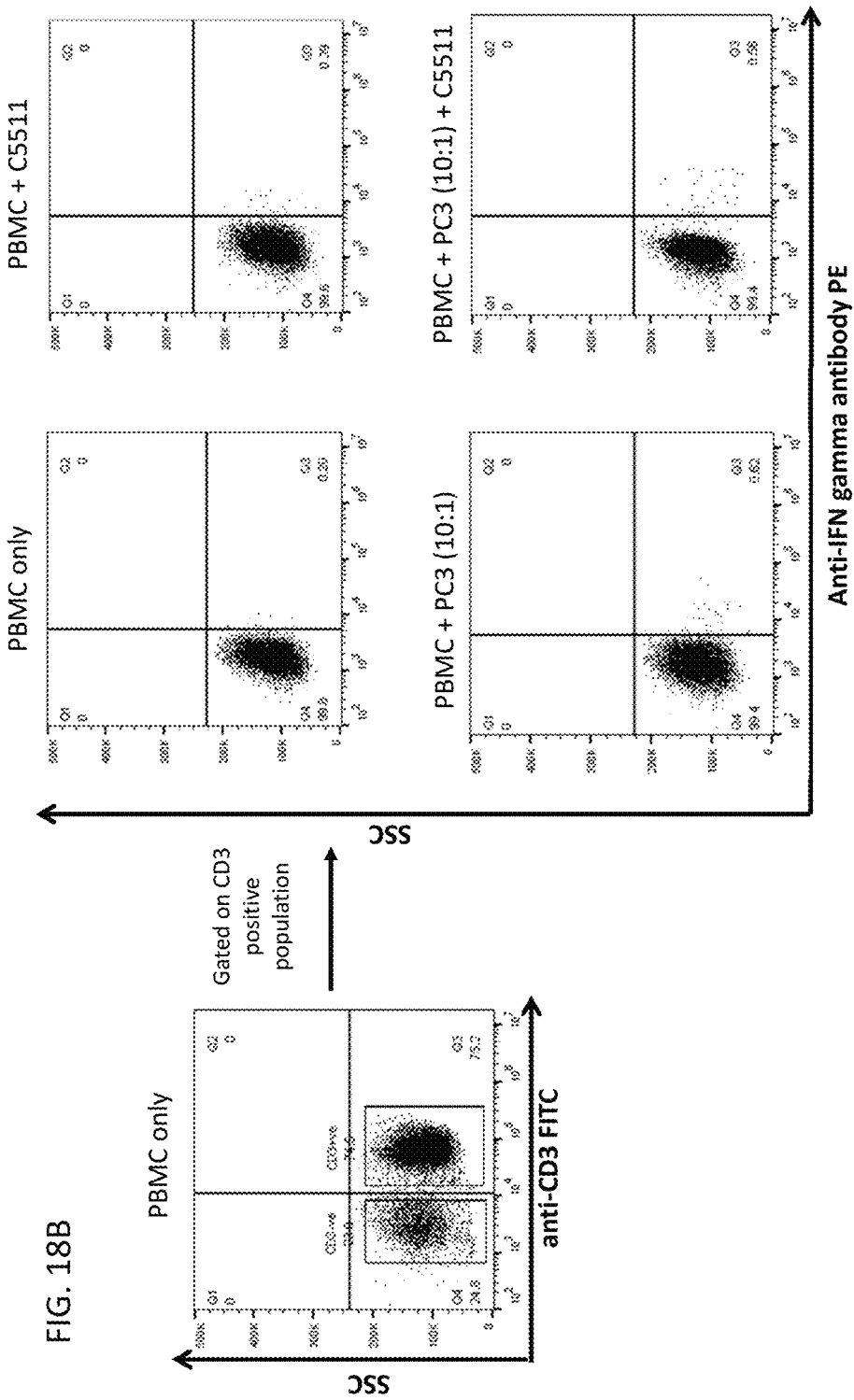
Figure 18D:
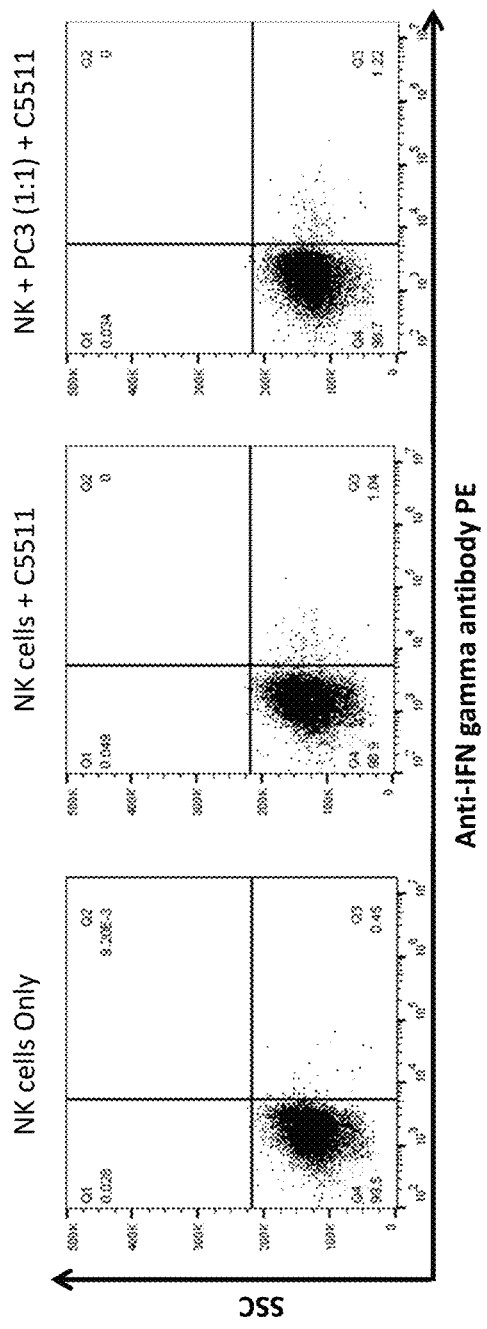

As can be seen from FIG. 18A, release of IFN-γ in PBMCs when induced with C5511, anti-CLEC2D antibody, at a concentration of 100 μg/mL was found to be ~2.97% as compared to uninduced control. Anti OKT-3 antibody, an anti CD3 antibody conjugated with FITC, was used as a positive control, showed 3-6% IFN-γ release when compared with uninduced PBMC (FIG. 18A). Subsequently PBMC cells were gated based on CD3+ive and –ive populations wherein CD3+ cells from total PBMC showed non-significant increase of IFN-γ release when treated with Anti-CLEC2D antibody, either alone or with target cells (at T:E ratio 1:10) (FIG. 18B). On the contrary, CD3–ive population exhibited significant increase of IFN-γ release upon treatment with Anti-CLEC2D antibody (FIG. 18C). It should be noted here that there was no or low increase in IFN-γ production in PC3 primed effector cells, either with whole PBMC or CD3+ cells or CD3– cells. Extending the observation to isolated NK cells, IFN-γ release experiments were performed wherein 1-2% of IFN-γ release, to an approximate, was monitored in the presence of Anti-CLEC2D antibody (FIG. 18D). Taken together, release of cytokine, such as IFN-γ, was elevated upon treatment of anti-CLEC2D antibody, as described in present disclosure. The said observation mediated through anti-CLEC2D antibody is subject to binding to CLEC2D antigen, expressed on effector cells, not limited to CD3-/NK cells, suggesting an independent pathway towards activation of other immune cells and essentially effective clearance of target cells.

Cytotoxicity Mechanism:

To understand the functional role of Anti-CLEC2D antibody in the cytotoxicity mechanism, anti-CLEC2D isotype variants were constructed and assessed in cytotoxicity assay.

Generation Relevant Isotype Constructs

Figure 19B:
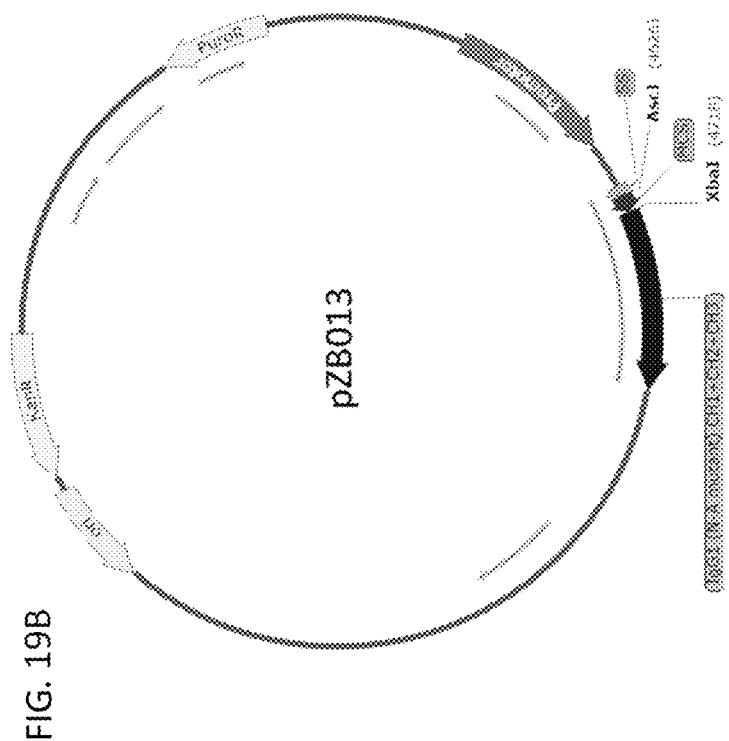
Figure 19A:
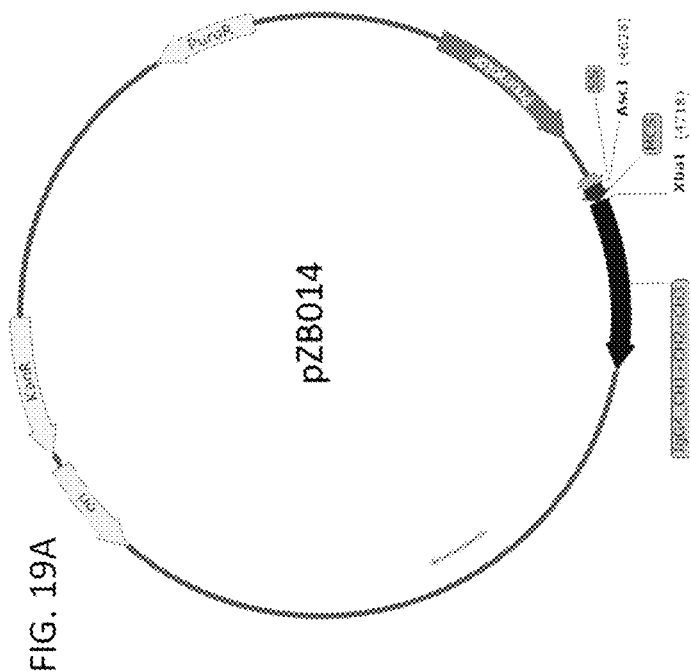

As exemplified, mammalian expression vector pZB013 (accession #MTCC 25364) with IgG1, N→A mutation and pZB014 (accession #MTCC 25365) with IgG4 were generated, wherein selected anti-CLEC2D variable heavy chain region could be cloned. Subsequently said constructs with variable heavy chain and pZB008 (accession #MTCC 25359) with variable light chains, will be transfected, expressed and purified for subsequent experimentation. Both the mammalian constructs pZB013 with IgG1, N→A mutation and pZB014 with IgG4 were custom designed and synthesized (FIGS. 19A and 19B). The plasmid which carries a kanamycinR/puromycinR cassette driven by strong promoter and high-copy-number ColE1/pMB1/pBR322/pUC origin of replication for propagation. The variable heavy chain can be replaced using restriction enzyme AscI and XbaI. The variable light chain can be replaced by restriction enzyme EcoRI and AscI.

As exemplified herein, PCR was performed using sequence specific primers which were synthesized at Eurofins, and pZB014 and pZB008 vectors were restriction endonuclease activity with respective enzymes and the PCR amplified product was extracted using QIAquick Gel Extraction kit, infusion cloning was done using Infusion HD Cloning Plus CE from and 50% of mixture were transformed into Stellar competent cells E. coli and plated onto Kanamycin—containing LB agar plates. Plasmid DNA from transformed colonies was purified by QIAprep Spin Miniprep kit (Qiagen) and sequenced at Eurofins and large scale plasmid was isolated and used for transfection. Herein, Transformation of plasmid DNA into bacterial cell by heat shock method and Plasmid DNA Isolation from bacterial cells using QIAGEN kit and clone screening was similar to as described in section above. All clones were subsequently sequence verified and found to be error free. Respective anti CLEC2D clones in both IgG4 and/or IgG1 mutant formats, were isolated in large scale for transfection into mammalian expression system, CHO cells.

CHO Cell Transfection to Express Novel Anti-CLEC2D Monoclonal Antibody IgG4 Variants:

As exemplified, for transfection, cell count and viability data was collected using Vi-cell XR automated cell counter, Beckman coulter. Transfection was carried out as per manufacturer's protocol Lipofectamine® LTX Reagent with PLUS Reagent. Required volume of cell suspension was centrifuged at 1400-1500 RPM for 4-5 mins and re-suspended in specified volume of OPTIMEM I as per Table 36 in 125 ml shake flask. Transfection mix was prepared as per Table 3. Refer Table A for DNA details. 2-3 days post transfection 10 ml Power CHO2 CD growth media was added and Glutamax was added from 200 mM stock to achieve final concentration of 2 mM. Day 6 post transfection, cell culture supernatant was harvested by centrifugation at 1400-2000 rpm for 10-15 minutes. IgG4 antibody variants were purified from cell culture supernatant by Protein A affinity chromatography.

TABLE 36

Example of transfection with IgG4 constructs

| Parameters | Details |
|---|---|
| Total volume of transfection | 50 ml |
| Cell density | 1.25 ×10^6 cells/ml |
| OPTIMEM I | 12.5 ml |
| Total DNA | 25 μg |
| HC:LC | 1:3 |
| Amount of DNA: Lipofectamine | 1:3 |
| Amount of DNA: Plus reagent | 1:1 |

As exemplified by, C4701, C3276, C3256 clones, not limited to, were transfected for further purification and evaluation in cytotoxicity assay.

TABLE 37

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1481 | EVQLVQSGAEVKKPGASVKV SCKASGYTFTSYAMHWVRQA PGQRLEWMGWINAGNGNTK YSQKFQGRVTITRDTSASTAY MELSSLRSEDTAVYYCARGSL SRSGWYAGLFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT | SEQ ID 1589 | ETTLTQSPATLSVSLGERATLSC RASQSIGSNLVWYQLKPGQGPR LVIYSATSRATGIPARFSGSGSGT EFILSISNLQSEDLAVYYCQQYGS SPPTTFGQGTRLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | | |
| SEQ ID 1482 | QITLKESGGGVVQPGRSLRLS CAASGFTFSSYSMNWVRQAP GKGLQWVAIISDDGSKSYYAD SVQGRFTISRDNSRNTVFLQM NSLRAEDTAMYYCARDRGTK WNQLNDVFDMWGQGTMVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1590 | EIVMTQSPATLSLSPGERATLSC RASQSVSSSYLAWYQQKPGRAP RLLIYGASNRATGIPDRFSGSGS GTDFTLIISRLEPEDFALYYCQQY GSSPGTFGQGTKVDIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1483 | EVQLVQSGAEVKKPGASVKV SCKASGYTFTSYYMHWVRQA PGQGLEWMGIINPSGGSTSY AQKFQGRVTMTRDTSTSTVY MELSSLRSEDTAVYYCARGR GYSSSRLYYFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1591 | DVVMTQSPATLSLSPGERATLSC RASQSVSSYLAWYQQKPGQAPR LLIYDASNRATGIPARFSGSGSGT DFTLTISSLEPEDFAVYYCQQRS NWPRTFGQGTKLEIKRTVAAPSV FIPPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1484 | QVTLKESGGGLVRPGGSLRL SCEASGFTFSDPYMDWRQA PGKGLEWVGRITNKRTGYATT YAASVKDRFTISRDDSRKSVY LQMNSLKTEDTAVYYCATDVS GSFAAYGGQGTLVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH | SEQ ID 1592 | EIVLTQSPDSLAVSLGERATITCK SSRNILYSGNNKNFLAWYQHKP GQPPKLLIYWASTRESGVPDRFS GSGSGTDFTLTINSLEAEDAATY YCHQSSSLPHTFGPGTKVDIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | | |
| SEQ ID 1485 | EVQLVQSGGGVVQPGRSLRL SCAASGFTFSSYAMHWVRQA PGQRLEWMGWINAGNGNTK YSQKFQGRVTITRDTSASTAY MELSSLRSEDTAVYYCAGEG GAVAGTVYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1593 | ETTLTQSPGTLSLSPGQRATLSC RASESVSKSYLLWYQQKPGQAP RLLIYGASTRASGIPNRFSGSGS GTDFTLTISRLEPEDSAVYYCQH YGSSRTFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1486 | QVQLVQSGGGLVKPGGSLRL SCAASGFTFSNAWMSWVRQ APGKGLEWVGRIKSKTDGGT TDYAAPVKGRFTISRDDSKNT LYLQMNSLKTEDTAVYYCTTD EYFYWGQGTLVTVSSASTKG PSVFPLAPSSKSTSGGTAALG CLVKDYFPEPVTVSWNSGALT SGVHTFPAVLQSSGLYSLSSV VTVPSSSLGTQTYICNVNHKP SNTKVDKKVEPKSCDKTHTCP PCPAPELLGGPSVFLFPPKPK DTLMISRTPEVTCVVVDVSHE DPEVKFNWYVDGVEVHNAKT KPREEQYNSTYRVVSVLTVLH QDWLNGKEYKCKVSNKALPA PIEKTISKAKGQPREPQVYTLP PSREEMTKNQVSLTCLVKGFY PSDIAVEWESNGQPENNYKT TPPVLDSDGSFFLYSKLTVDK SRWQQGNVFSCSVMHEALH NHYTQKSLSLSPGK | SEQ ID 1594 | ETTLTQSPGTLSLSPGERATLSC RASQSISSTYLAWYQQKPGQAP RLLIYGASTRATGIPDRFSGSGS GTDFTLSISRLEPEDFAVYYCQQ YGNSPPGATFGQGTRLEIKRTVA APSVFIFPPSDEQLKSGTASVVCL LNNFYPREAKVQWKVDNALQSG NSQESVTEQDSKDSTYSLSSTLT LSKADYEKHKVYACEVTHQGLSS PVTKSFNRGEC |
| SEQ ID 1487 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARVNPGSYT REVSNFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT | SEQ ID 1595 | DIQLTQSPSSLSASVGERVTITCR SSQALRNVVGLGDDLAWYQHTP GSAPKILIYSTSTLQSGVSSRFSG GKSGRDFTLTIDRLQPGDSATYY CLQHHDFPPTFGPGTKVEIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | CLVKGFYPSDIAVEWESNGQ<br>PENNYKTTPPVLDSDGSFFLY<br>SKLTVDKSRWQQGNVFSCSV<br>MHEALHNHYTQKSLSLSPGK | | |
| SEQ ID 1488 | QVQLQQSGPELVKPSQTLTLT<br>CGISGDSVSSNSVTWNWVRQ<br>SPSRGLEWLGRTYYRSQWYY<br>NYAVSVKSRITISPDTSKNQFS<br>LQLNSVTPEDTAVYYCATRGH<br>NYGVDYWGPGTTVTVSSAST<br>KGPSVFPLAPSSKSTSGGTAA<br>LGCLVKDYFPEPVTVSWNSG<br>ALTSGVHTFPAVLQSSGLYSL<br>SSVVTVPSSSLGTQTYICNVN<br>HKPSNTKVDKKVEPKSCDKT<br>HTCPPCPAPELLGGPSVFLFP<br>PKPKDTLMISRTPEVTCVVVD<br>VSHEDPEVKFNWYVDGVEVH<br>NAKTKPREEQYNSTYRVVSVL<br>TVLHQDWLNGKEYKCKVSNK<br>ALPAPIEKTISKAKGQPREPQV<br>YTLPPSREEMTKNQVSLTCLV<br>KGFYPSDIAVEWESNGQPEN<br>NYKTTPPVLDSDGSFFLYSKL<br>TVDKSRWQQGNVFSCSVMH<br>EALHNHYTQKSLSLSPGK | SEQ ID 1596 | DVVMTQSPLSLPVTPGEPASISC<br>RSSQSLLNSNGYNYLEWYLQKP<br>GQSPQLLIYLGSNRASGVPDRFS<br>GSGSGTDFTLKISRVEADDAGVY<br>YCMQSLQTPLTFGGGTKLEIKRT<br>VAAPSVFIFPPSDEQLKSGTASV<br>VCLLNNFYPREAKVQWKVDNAL<br>QSGNSQESVTEQDSKDSTYSLS<br>STLTLSKADYEKHKVYACEVTHQ<br>GLSSPVTKSFNRGEC |
| SEQ ID 1489 | QVQLVQSGGGLVKPGGSLRL<br>SCAASGFTFSNAWMSWVRQ<br>APGKGLEWCRIKSKTDGETT<br>DYAAPVKGRFTISRDDSKNTL<br>YLQMNSLKTEDTAVYHCTTGV<br>GWSPFQYWGQGTLVTVSSAS<br>TKGPSVFPLAPSSKSTSGGTA<br>ALGCLVKDYFPEPVTVSWNS<br>GALTSGVHTFPAVLQSSGLYS<br>LSSVVTVPSSSLGTQTYICNV<br>NHKPSNTKVDKKVEPKSCDK<br>THTCPPCPAPELLGGPSVFLF<br>PPKPKDTLMISRTPEVTCVVV<br>DVSHEDPEVKFNWYVDGVEV<br>HNAKTKPREEQYNSTYRVVS<br>VLTVLHQDWLNGKEYKCKVS<br>NKALPAPIEKTISKAKGQPREP<br>QVYTLPPSREEMTKNQVSLTC<br>LVKGFYPSDIAVEWESNGQPE<br>NNYKTTPPVLDSDGSFFLYSK<br>LTVDKSRWQQGNVFSCSVMH<br>EALHNHYTQKSLSLSPGK | SEQ ID 1597 | ETTLTQSPGTLSLSPGERATLSC<br>RASQSVSSSYLAWYQQKPGQAP<br>RLLIYGASSRATGIPDRFSGSGS<br>GTDFTLTISRLEPEDFAVYYCQQ<br>YGSSPRITFGQGTRLEIKRTVAAP<br>SVFIFPPSDEQLKSGTASVVCLLN<br>NFYPREAKVQWKVDNALQSGNS<br>QESVTEQDSKDSTYSLSSTLTLS<br>KADYEKHKVYACEVTHQGLSSP<br>VTKSFNRGEC |
| SEQ ID 1490 | EVQLVQSGGGLVQPGRSLRL<br>SCTASGFTFGDYAMSWFRQA<br>PGKGLEWVGFIRSKAYGGTT<br>EYAASVKGRFTISRDDSKSIAY<br>LQMNSLKTEDTAVYYCTRDD<br>KIAAAGFTYWYFDLWGRGTLV<br>TVSSASTKGPSVFPLAPSSKS<br>TSGGTAALGCLVKDYFPEPVT<br>VSWNSGALTSGVHTFPAVLQ<br>SSGLYSLSSVVTVPSSSLGTQ<br>TYICNVNHKPSNTKVDKKVEP<br>KSCDKTHTCPPCPAPELLGGP<br>SVFLFPPKPKDTLMISRTPEVT<br>CVVVDVSHEDPEVKFNWYVD<br>GVEVHNAKTKPREEQYNSTY<br>RVVSVLTVLHQDWLNGKEYK<br>CKVSNKALPAPIEKTISKAKGQ<br>PREPQVYTLPPSREEMTKNQ<br>VSLTCLVKGFYPSDIAVEWES<br>NGQPENNYKTTPPVLDSDGS<br>FFLYSKLTVDKSRWQQGNVF<br>SCSVMHEALHNHYTQKSLSLS<br>PGK | SEQ ID 1598 | DVVMTQSPATLSVSPGERATLSC<br>RASQSVSSNLAWYQQKPGQAPR<br>LLIYGASTRATGIPARFSGSGSGT<br>EFTLTISSLQSEDFAVYYCQQYN<br>NWPPMYTFGQGTKLEIKRTVAAP<br>SVFIFPPSDEQLKSGTASVVCLLN<br>NFYPREAKVQWKVDNALQSGNS<br>QESVTEQDSKDSTYSLSSTLTLS<br>KADYEKHKVYACEVTHQGLSSP<br>VTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1491 | QVQLVQSGAEVKKPGASVKV SCKASGYTFAAYYLHWVRQA PGQGLEWMGRISPGNGVTSY AQKFQGRVTMTGDTSINTVY MQLNNLISGDTAVYYCAREAA DDPFDHWGQGALVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | SEQ ID 1599 | DVVMTQSPATLSVSPGERVTLSC RASQSVRDNVGWYKQKPGQPP RLVIYGASTRATGIPARISGSGSG TEFTLTISSLQSEDFAVYYCQQFN NWPYTFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1492 | EVQLVQSGGGVVQPGRSLTL SCAASGFTFSSHLMHWVRQA PGKGLEWVAVISYDGTSKYY GDSVKGRFTISRDNSKNTLYL QMNSLRAEDTAIYYCAKADYK YDWGQGTLVTVSSASTKGPS VFPLAPSSKSTSGGTAALGCL VKDYFPEPVTVSWNSGALTS GVHTFPAVLQSSGLYSLSSVV TVPSSSLGTQTYICNVNHKPS NTKVDKKVEPKSCDKTHTCPP CPAPELLGGPSVFLFPPKPKD TLMISRTPEVTCVVVDVSHED PEVKFNWYVDGVEVHNAKTK PREEQYNSTYRVVSVLTVLHQ DWLNGKEYKCKVSNKALPAPI EKTISKAKGQPREPQVYTLPP SREEMTKNQVSLTCLVKGFYP SDIAVEWESNGQPENNYKTT PPVLDSDGSFFLYSKLTVDKS RWQQGNVFSCSVMHEALHN HYTQKSLSLSPGK | SEQ ID 1600 | DIQMTQSPSSLSASVGDRVTITC RASQSISSYLNWYQQKPGKAPN LLIYAASSLHTGVPSRFSGSGSG TDFTLTISSLQPEDFATYYCQQSY SIPRTFGQGTKVEIKRTVAAPSVF IFPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1493 | EVQLVQSGGGLVKPGGSLRL SCTASGFTFGDYAMSWVRQA PGKGLEWVGFIRSKAYGGTT EYAASVKGRFTISRDDSKSIAY LQMNSLKTEDTAVYYCTTHRR PIYDILTGFDYWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1601 | DVVMTQSPATLSVTPGERATLSC RASQSVNSNVAWYQQKPGQAP RLLIYDVSTRATDIPARFSGSGSG TDFTLTISRLDPEDFAVYYCQQC ASSPPVTFGGGTKLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1494 | QLQLQESGGGLVQPGRSLRL SCTASGFTFGDYAMSWvRQA PGKGLEWVGFIRSKAYGGTT EYAASVKGRFTISRDDSKSIAY LQMNSLKTEDTAVYYCTREDT MVRGVIPWGQGTLVTVSSAS | SEQ ID 1602 | EIVMTQSPATLSLSPGERATLSC GASQSVSSSYLAWYQQKPGLAP RLLIYDASSRATGIPDRFSGSGS GTDFTLTISRLEPEDFAVYYCQQ YGSSPRVTFGGGTKVDIKRTVAA PSVFIFPPSDEQLKSGTASVVCLL |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | | NNFYPREAKVQWKVDNALQSGN SQESVTEQDSKDSTYSLSSTLTL SKADYEKHKVYACEVTHQGLSS PVTKSFNRGEC |
| SEQ ID 1495 | QLQLQESGSGLVKPSQTLSLT CAVSGGSISSGGYSWSWIRQ PPGKGLEWIGYIYHSGSTYYN PSLKSRVTISVDRSKNQFSLKL SSVTAADTAVYYCARDRRYY DSSGYYPAYYFDYWGQGTLV TVSSASTKGPSVFPLAPSSKS TSGGTAALGCLVKDYFPEPVT VSWNSGALTSGVHTFPAVLQ SSGLYSLSSVVTVPSSSLGTQ TYICNVNHKPSNTKVDKKVEP KSCDKTHTCPPCPAPELLGGP SVFLFPPKPKDTLMISRTPEVT CVVVDVSHEDPEVKFNWYVD GVEVHNAKTKPREEQYNSTY RVVSVLTVLHQDWLNGKEYK CKVSNKALPAPIEKTISKAKGQ PREPQVYTLPPSREEMTKNQ VSLTCLVKGFYPSDIAVEWES NGQPENNYKTTPPVLDSDGS FFLYSKLTVDKSRWQQGNVF SCSVMHEALHNHYTQKSLSLS PGK | SEQ ID 1603 | DVVMTQSPGTLSLSPGERATLSC RASQSVSSSALAWFQQKPGQAP RLLIYDSSSRATGIPDSFSGSGSG TEFTLTISSLQPEDFATYYCQQFN TYPNTFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1496 | EVQLVQSGGGLVKPGGSLRL SCAASGFTFSSYSMNWVRQA PGKGLEWVSYISSSGSYTNYA DSVKGRFTISRDNAKNSLYLQI NSLRAEDTAIYYCARDGGYDS SGFHDYWGQGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | SEQ ID 1604 | DIQMTQSPLSLPVTPGEPASISCR SSQSLLHSNGYNYLDWFLQKPG QSPRLLIYMGSSRASGVPERFSG SGSGTDFTLKISRVEAEDVGVYY CMQTLHTVTFGGGTKVEIKRTVA APSVFIFPPSDEQLKSGTASVVCL LNNFYPREAKVQWKVDNALQSG NSQESVTEQDSKDSTYSLSSTLT LSKADYEKHKVYACEVTHQGLSS PVTKSFNRGEC |
| SEQ ID 1497 | QVQLQQSGPGLVKPSQTLSL TCAISGDSVSNNRAAWNIR QSPSRGLEWLGRTYYRSKWY NEYAVSVKSRITINPDTSKNQF SLQLNSMTPEDSAVYYCAILP SSGYLQDHHYYGMDVWGQG TTVTVSSASTKGPSVFPLAPS SKSTSGGTAALGCLVKDYFPE PVTVSWNSGALTSGVHTFPA VLQSSGLYSLSSVVTVPSSSL GTQTYICNVNHKPSNTKVDKK | SEQ ID 1605 | ETTLTQSPGTLSLSPGERATLSC RASQSVSSSYLAWYQQKPGQAP RLLIYGASSRATGIPDRFSGSGS GTDFTLTISRLEPEDFAVYYCQQ YGSSLLFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | VEPKSCDKTHTCPPCPAPELL GGPSVFLFPPKPKDTLMISRT PEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | | |
| SEQ ID 1498 | EVQLVQSGAEVKKPGASVKV SCKASGYTFTSYGISWVRQAP GQGLEWMGWISAYNGNTNY AQKLQGRVTMTTDTSTSTAY MELSSLRSEDTAVYYCARAAV GDGYSYGRLDWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1606 | DIQLTQSPSFLSASVGDRVTITCR ASQGISSSLAWYQQKPGKAPKLL IYAASTLQSGVPSRFSGSGSGTD FTFTISSLQPEDIATYYCQQYDNL PPLTFGGGTKVEIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1499 | EVQLVQSGAEVKKPGESLKIS CKGSGYSFTSYWIGWVRQMP GKGLEWMGIIYPGDSDTRYSP SFQGQVTISADKSISTAYLQW SSLKASDTAMYYCARLPSYYY DSSGYFTWYFDLWGRGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1607 | DVVMTQSPLSLPVTPGEPASISC RSSQSLLHSNGYNYLDWYLQKP GQSPQLLIYLGSNRASGVPDRFS GSGSGTDFTVKISRVEAEDVGVY YCMQALQTPYTFGQGTKLEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1500 | EVQLVQSGAEVKKPGASVKV SCKASGYTFTSYGISWVRQAP GQGLEWMGWIIPIFGIANYAQ KFQGRVTITADKSTSTAYMEL SSLRSEDTAVYYCARELYNYG SKDYFDYWGQGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS | SEQ ID 1608 | EIVLTQSPLSLPVTLGQPASISCR SCQSLVYSDGNTYLNCFQQRPG QSPRRLIYKVSNRDSGVPDRFSG SGSGTDFTLEISRVEAEDVGIYFC MQGLQTPFTFGPGTKVDIKRTVA APSVFIFPPSDEQLKSGTASVVCL LNNFYPREAKVQWKVDNALQSG NSQESVTEQDSKDSTYSLSSTLT LSKADYEKHKVYACEVTHQGLSS PVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | | |
| SEQ ID 1501 | EVQLVQSGAEVKKPGESLKIS CKGSGYSFTSYWIGWVRQMP GKGLEWMGIIYPGDSDTRYSP SFQGQVTISADKSISTAYLQW SSLKASDTAMYYCARGGTWD TAMVTGFDYWGQGTLVTVSS ASTKGPSVFPLAPSSKSTSGG TAALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1609 | DVVMTQSPGTLSLSPGERATLSC RASQSVSSSYLAWYQQKPGQAP RLLIYGASSRATGIPDRFSGSGS GTDFTLTISRLEPEDFAVYYCQQ YGSSPALTFGGGTKLEIKRTVAA PSVFIFPPSDEQLKSGTASVVCLL NNFYPREAKVQWKVDNALQSGN SQESVTEQDSKDSTYSLSSTLTL SKADYEKHKVYACEVTHQGLSS PVTKSFNRGEC |
| SEQ ID 1502 | EVQLVQSGAEVKKPGESLKIS CKGSGYSFTSYWIAWVRQMP GKGLEWMGVIYPGDSDTRYS PSFQGQVTISADKSINTAYLQ WSSLKASDTAMYYCARPHYDI LTGSRAPFDYWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1610 | EIVMTQSPLSLPVTPGEPASISCR SSQSLLHSNGYNYLDWYLQKPG QSPQLLIYLGSTRASGVPDRFSG SGSGTDFTLKISRAEAEDVGVYY CMQALHTPWTFGLGTKVDIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |
| SEQ ID 1503 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARARVESKD GYFDYWGQGTLVTVSSASTK GPSVFPLAPSSKSTSGGTAAL GCLVKDYFPEPVTVSWNSGA LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA | SEQ ID 1611 | DIQMTQSPATLSVSPGERATLFC RASEGLTTNLAWYQHKPGQAPR LLIYAASTRATGVPARFSGSGSG TDFTLTISSLQSEDSAVYYCQQY NHWPLYTFGQGTKVEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | LHNHYTQKSLSLSPGK | | |
| SEQ ID 1504 | EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1612 | DIQLTQSPSTLSLSPGERATLSCRASQSVSSYLAWYQQKSGQAPRLLIYDASNRATGIPARFSGSGSTDFTLTISSLEPEDFAVYYCQQGSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1505 | QITLKESGGGLVQPGGSLRLSCTVSGFTFSNNWMTWVRQTPGKGLEWANIKQDGTEKHYVDSVKGRFTISRDNAENSLYLQMNSLRGEDTAVYYCARNSQRSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1613 | DIVMTHTPLSSPVTLGQPASISCRSSQSLEHTDGNTYLSWLHQRPGQPPRLLIYKVSTRFSGVPDRFSGSGAGTDFTLKISRVEAEDVGVYYCVQATHYPRTFGHGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1506 | QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCAKDLGDPRGGILNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1614 | EIVLTQSPGTLSLSPGERATLSCRASQSISGSYLAWYQQKRGQAPRLLIYDASSRAEGIPDRFIGSGSGTDFTLTISRLEPEDFAMYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1507 | EVQLVESGGGVVQPGRSLRLSCAASGFTFSSYAMHWVRQAPGKGLEWVAVISYDGSNKYYADSVKGRFTISRDNSKNTLYL | SEQ ID 1615 | EIVLTQSPDSLPVTPGEPASISCRSSQSLLHSNGNNYLDWYLQKPGQSPQLLIYLGSNRASGVPDRFSGSGSGTDFTLKLSRVEAEDVGVYY |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | QMNSLRAEDTAVYYCARSSP WGELSLYQGAFDIWGQGTMV TVSSASTKGPSVFPLAPSSKS TSGGTAALGCLVKDYFPEPVT VSWNSGALTSGVHTFPAVLQ SSGLYSLSSVVTVPSSSLGTQ TYICNVNHKPSNTKVDKKVEP KSCDKTHTCPPCPAPELLGGP SVFLFPPKPKDTLMISRTPEVT CVVVDVSHEDPEVKFNWYVD GVEVHNAKTKPREEQYNSTY RVVSVLTVLHQDWLNGKEYK CKVSNKALPAPIEKTISKAKGQ PREPQVYTLPPSREEMTKNQ VSLTCLVKGFYPSDIAVEWES NGQPENNYKTTPPVLDSDGS FFLYSKLTVDKSRWQQGNVF SCSVMHEALHNHYTQKSLSLS PGK | | CMQGLQIPITFGPGTKVDIKRTVA APSVFIFPPSDEQLKSGTASVVCL LNNFYPREAKVQWKVDNALQSG NSQESVTEQDSKDSTYSLSSTLT LSKADYEKHKVYACEVTHQGLSS PVTKSFNRGEC |
| SEQ ID 1508 | QITLKESGGGLVQPGRSLRLS CAASGFTFDDYAMHWVRQAP GKGLEWVSAISGSGGSTYYA DSVKGRFTISRDNSKNTLYLQ MNSLRAEDTAVYYCAKDNDF WSGKVFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1616 | DIQMTQSPSSVSASVGDRVTITC RASQNIRHWLVWYQQKLGQAPK LLIYAASNLQSGVPSRFSGSGSG TEFTLTINSLQAEDFATYYCLQHN SYPWTFGQGTKVEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1509 | EVQLVQSGGGLVQPGGSLRL SCAASGFTFSSYSMNWVRQA PGKGLEWSYISSTSSTIYYA DSVKGRFTISRDNSKNMLFLQ MNSLRAEDTAVYYCAKEGGS GWRHYFDYWGQGTLVTVSS ASTKGPSVFPLAPSSKSTSGG TAALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1617 | EIVLTQSPDFQSVTPKQKVTITCR ASQSIGGSLHWYQQKPGQSPKLI IKYASQSFSGVPSRFSGSGSGTD FTLTIDSLEAEDAATYYCHQSISL PLTFGGGTKVDIKRTVAAPSVFIF PPSDEQLKSGTASVVCLLNNFYP REAKVQWKVDNALQSGNSQESV TEQDSKDSTYSLSSTLTLSKADY EKHKVYACEVTHQGLSSPVTKSF NRGEC |
| SEQ ID 1510 | QVTLKESGGGVVQPGRSLRL SCAASGFTFSSYAMHWVRQA PGKGLEWAVISYDGSNKYY ADSVKGRFTISRDNSKNTLYL QMNSLRAEDTAVYYCARDYC SSTSCQNWFDPWGQGTLVTV SSASTKGPSVFPLAPSSKSTS | SEQ ID 1618 | ETTLTQSPGTLSLSPGEGATLSC RASQSVTSNYLAWYQQKPGQAP RLLIYGASYRATGIPDRFSGSGS GTDFTLTISRLEPEDFAVYYCQQ YASSVTFGQGTRLEIKRTVAAPS VFIFPPSDEQLKSGTASVVCLLNN FYPREAKVQWKVDNALQSGNSQ |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | | ESVTEQDSKDSTYSLSSTLTLSK ADYEKHKVYACEVTHQGLSSPVT KSFNRGEC |
| SEQ ID 1511 | QVQLVQSGGGLVQPGGSLRL SCAASGFTFSNYVMSWVRQA PGKGLEWSAISGIGDTTYYA DSVKGRFTISRDNAKNTLYLQ MNSLRAEDTAVYYCARGRVA GDAFDIWGQGTMVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | SEQ ID 1619 | DVVMTQSPATLSVSPGERATLSC RASQSISSNLAWYQQKPGQAPR LLIYGASTRATGIPARFSGSGSGT EFTLTISSLQSEDFAVYYCQQYN NWPRTFGQGTKLEIKRTVAAPSV FIPPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1512 | QLQLQESGGGLVQPGGSLRL SCAASGFTFSSYAMSWRQA PGKGLEWSAISGSGGSTYY ADSVKGRFTISRDNSKNTLYL QMNSLRAEDTAVYYCAKDQG AAAGTLGYFDYWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1620 | DIQLTQSPDSLAVSLGERATINCK SSQSVLYSSNNKNYLAWYQQKP GQPPKLLIYWASARESGVPDRFS GSGSGTDFTLTINSLQAEDVAVY YCQQFYSPPRTFGQGTKVEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1513 | QVQLVQSGAEVKKPGASVKV SCKASGYTFTSYDINWRQAT GQGLEWMGWMNPNSGNTG YAQKFQGRVTMTRNTSISTAY MELSSLRSEDTAVYYCTRGIY DSSGSSNPFDSWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV | SEQ ID 1621 | EIVLTQSPGTLSLSPGERATLSCR ASQSVSSSYLAWYQQKPGQAPR LLIYGASSRATGIPDRFSGSGSGT DFTLTISRLEPEDFAVYYCQQYG SSPPGTFGGGTKVDIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | | |
| SEQ ID 1514 | EVQLVQSGAEVKKPGASVKIS CEASGYTFTDYAIHWVRQAP GQRLEWMGWINAGDGGTKS SREFQGRVTITRDTSATTAYM EVSSLRSEDTAVYYCARGYC SGGSCPGTDFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1622 | EIVLTQSPGTLSLSPGERATLSCR ASQSLSTNLAWYQQKPGQAPRL LIYGASTRATGIPARFSGSGSGTE FTLTITSLQSEDFAVYYCQQYHN WPPYTFGQGTKVEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1515 | QVQLVQSGAEVKKPGASVKV SCKASGYTFTSYYMHWVRQA PGQGLEWMGIINPGSGSTSY AQKFQGRVTMTRDTSTSTVY MELSSLRSEDTAVYYCARDG VGGRDGYNFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1623 | DIQMTQSPSTLSASVGDRVTITC RASQSISSWLAWYQQKPGKAPK LLIYKASSLESGVPSRFSGSGSG TEFTLTISSLQPDDFATYYCQQY NSYWTFGQGTKVEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1516 | EVQLVQSGGGLVQPGGSLRL SCAASGFTVSSNYMSWVRQA PGKGLEWSVIYSGGSTYYA DSVKGRFTISRDNSKNTLYLQ MNSLRAEDTAVYYCARAPLAA DGYFDYWGQGTLVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV | SEQ ID 1624 | ETTLTQSPGTLSLSPGEGATLSC RASHSVGANYIAWYQQKPGQAP RLLIHTASKRATGVPERFSGSGS GTDFTLSISRLEPEDFAVYHCQQ YAAAPITFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | | |
| SEQ ID 1517 | EVQLVQSGAEVKKPGSSVKV SCKASGGTFSSYAISWVRQA PGQGLEWMGGIIPIFGTANYA QKFQGRVTITADESTSTAYME LSSLRSEDTAVYYCARARGLQ YLIWYFDLWGRGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | SEQ ID 1625 | EIVMTQSPSSLSASVGDRVIITCR ASQGIANYLAWYQQKPGKGPKL LIYASSTLQSGVPSRFSGSGSGT DFTLTISGLQPEDVATYYCQKYN SVPLTFGGGTKVDIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1518 | QVQLVQSGAEVKKPGASVKV SCKASGYTFTSYYMHWVRQA PGQGLEWMGIINPSGGSTSY AQKFQGRVTMTRDTSTSTVY MELSSLRSEDTAVYYCASPG MVRGVITAPLDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1626 | DVVMTQSPVSLAVSLGERATINC KSSQSVLYRTNNKNYLAWYQQK PGQPPKLLIYWASTRESGVPDRF SGSGSGTDFTLTISSLQPEDVAV YYCQQYYNLPRSFGQGTKLEIKR TVAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1519 | EVQLVQSGGGLVKPGGSLRL SCAASGFTFSSYAISWVRQAP GQGLEWMGGIIPMYGTANYA QKFQGRVTITADESTSTAYME LSSLRSEDTALYYCAREAKW GMYYFDYWGQGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | SEQ ID 1627 | DIVMTHTPDSLAVSLGERATINCK SNRSVLYSPNNQNYLGWYQQKP GQPPKLLIYWASTRDSGAPDRFS GSGSGTDFTLTINSLQAEDVAVY YCQQYASTPYTFGQGTKVEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1520 | EVQLVESGGGWVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1628 | DVVMTQSPATLSLSPGERATLSCRASESVNSNFLAWYQQKPGQAPRLLIYAASTRATGIPARFSGSGSGTEFTLIITSLQSEDFAVYYCQQYNNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1521 | QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1629 | DVVMTQSPATLSLSPGERATLSCRASQSVSSYLAWYQQKPGQAPRLLIYDASNRATGIPARFSGSGSGTDFTLTISSLEPEDFAVYYCQQRSNWSLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1522 | QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1630 | ETTLTQSPGTLSLSPGERATLSCRASQSVSSSYLAWYQQKPGQAPRLLIYGASTRATGIPDRFSGSGSGTDFTLTIGRLEPEDFAVYYCQHYGPSRRITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1523 | QVQLVQSGGGLVQPGRSLRL SCTASGFTFGDYAMSWFRQA PGKGLEWVGFIRSKAYGGTT EYAASVKGRFTISRDDSKSIAY LQMNSLKTEDTAVYYCTRGG TMVRGFGFNYWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1631 | ETTLTQSPDTLSVSPGGRATLSC RASQSIGSNLAWYQQKPGQSPR LLIYDASTRATGIPARFSGSGSGT EFTLTISSLESEDFVLYYCQQHGE WPTFGQGTRLEIKRTVAAPSVFIF PPSDEQLKSGTASVVCLLNNFYP REAKVQWKVDNALQSGNSQESV TEQDSKDSTYSLSSTLTLSKADY EKHKVYACEVTHQGLSSPVTKSF NRGEC |
| SEQ ID 1524 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARARRAMIG PLPRLVGYFDLWGRGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1632 | DVVMTQSPATLSLSPGERATLSC RASQSVGNSLAWYQQKPGQAP RLLIYDASNRATGIPARFSGSGS GTDFTLTITSLEPEDFAIYYCQQR GTWPPLTFGGGTKLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1525 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARGRPAPS WVKTRNWFDPWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1633 | DVVMTQSPSSLSASVGDTVTITC RASQSITNWLAWYQQKPGKAPK RLIYGASSLQSGVPSRFSGSGSG TEFTLTISSLQPEDFATYYCQQYT NYPRTFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1526 | QVQLQQSGPGLVKPSQTLSL TCAISGDSVSSNSAAWNWIR QSPSRGLEWLGRTYYRSKWY NDYAVSVKSRITINPDTSKNQF SLQLNSVTPEDTAVYYCAREA SSGWNWGQGTLVTVSSASTK | SEQ ID 1634 | DIQMTQSPSTLSASVGDRVTITC RARQSISNRLAWYQQKPGRAPN VLIYKASTLANGVPSRFSGSGSG TEFTLTISSLQPDDFATYYCQQY QSYWTFGPGTKVEIKRTVAAPSV FIFPPSDEQLKSGTASVVCLLNNF |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GPSVFPLAPSSKSTSGGTAAL GCLVKDYFPEPVTVSWNSGA LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | | YPREAKVQWKVDNALQSGNSQE SVTEQDSKDSTYSLSSTLTLSKA DYEKHKVYACEVTHQGLSSPVTK SFNRGEC |
| SEQ ID 1527 | QVQLQESGPGLVKPSQTLSLT CAISGDSVSSNNAAWNWIRQ SPSRGLEWLGRTFYRSKWYN DYAVSVKSRLTVNPDTSKNQF SLRLNSVSPEDTAVYYCARG GRYTKGGYFDDWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1635 | DIQLTQSPATLSLSPGERATLSCK ASQSVSSYLAWYQQKLGQAPRL LIYDASNRATGIPARFSASGSGTD FTLTISSLQPEDVATYYCQKYNSP PRTFGQGTKVEIKRTVAAPSVFIF PPSDEQLKSGTASVVCLLNNFYP REAKVQWKVDNALQSGNSQESV TEQDSKDSTYSLSSTLTLSKADY EKHKVYACEVTHQGLSSPVTKSF NRGEC |
| SEQ ID 1528 | QVTLKESGPTLVKPTQTLTLT CTFSGFSLSTSGVGVGWIRQ PPGKALEWLALIYWDDDKRYS PSLKSRLTITKDTSKNQVVLTM TNMDPVDTATYYCAHRLDSS GRGGYFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1636 | ETTLTQSPGTLSLSPGERVSLSC RASQNVYSNFLAWYQQRPGQAP SLLIYGASSRAAGVPDRFSGSGS GTDFALTISRVEPEDFAVYYCQQ YGTSPITFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1529 | EVQLVESGGGVVQPGRSLRL SCTASGFTFSSYGMHWRQA PGKGLEWVAVISYDGSNKYY ADSVKGRFTISRDNSKNTLYL QMNSLRAEDTAVYYCAKELV GTSSPYYYYYGMDVWGQG TMVTVSSASTKGPSVFPLAPS SKSTSGGTAALGCLVKDYFPE PVTVSWNSGALTSGVHTFPA VLQSSGLYSLSSVVTVPSSSL GTQTYICNVNHKPSNTKVDKK VEPKSCDKTHTCPPCPAPELL | SEQ ID 1637 | EIVLTQSPRSSPVTLGQPASISCR SSQSLEHGDGNTYLSWLQQRPG QPPRLLIYKVSNRLSGVPDRFSG SGAGTDFTLKISRVEAEDVGVYY CMQGIYWPRTFGQGTRLEIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GGPSVFLFPPKPKDTLMISRT PEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | | |
| SEQ ID 1530 | QLQLQESGGGLVQPGGSLRL SCAASGFTVSSNYMSWVRQA PGKGLEWVSVIYSGGSTYYA DSVKGRFTISRDNSKNTLYLQ MNSLRAEDTAVYYCARDYYY GSGSSPWGQGTLVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | SEQ ID 1638 | ETTLTQSPVTLSLSPGDRATLSC RASQSVSSTSLAWYQHKPGQAP RLLIYGASRRATGIPDRFSGSGS GTDFTLTINRLEPEDFAVYYCQH YGSSPPITFGQGTRLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1531 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARGRPYCS STSCYPEWFDPWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1639 | ETTLTQSPATLSVSPGERATLSC RASQSVGSKLAWYQQKPGQAP RLLIYGASTRATGVPVRFSGSGS GTEFTLTISSLQSEDFAVYYCQQ YNNWPPITFGQGTRLEIKRTVAA PSVFIFPPSDEQLKSGTASVVCLL NNFYPREAKVQWKVDNALQSGN SQESVTEQDSKDSTYSLSSTLTL SKADYEKHKVYACEVTHQGLSS PVTKSFNRGEC |
| SEQ ID 1532 | QVTLKESGGGVVQPGRSLRL SCAASGFTFSSYGMHWVRQA PGKGLEWVAVISYDGSNKYY ADSVKGRFTISRDNSKNTLYL QMNSLRAEDTAVYYCAKLRGI DYYDSSGYQRGFDYWGQGT LVTVSSASTKGPSVFPLAPSS KSTSGGTAALGCLVKDYFPEP VTVSWNSGALTSGVHTFPAVL QSSGLYSLSSVVTVPSSSLGT QTYICNVNHKPSNTKVDKKVE PKSCDKTHTCPPCPAPELLGG PSVFLFPPKPKDTLMISRTPEV TCVVVDVSHEDPEVKFNWYV DGVEVHNAKTKPREEQYNST YRVVSVLTVLHQDWLNGKEY KCKVSNKALPAPIEKTISKAKG | SEQ ID 1640 | EIVLTQSPLSLPVTPGEPASISCR SSQSLLHSNGYNYLDWYLQKPG QSPQLLIYLGSNRASGVPDRFSG SGSGTDFTLKISRVEAEDVGVYY CMQTLQTPLTFGGGTKVDIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | QPREPQVYTLPPSREEMTKN QVSLTCLVKGFYPSDIAVEWE SNGQPENNYKTTPPVLDSDG SFFLYSKLTVDKSRWQQGNV FSCSVMHEALHNHYTQKSLSL SPGK | | |
| SEQ ID 1533 | QVQLQESGPGLVKPSETLSLT CTVSGGSISSYYWSWIRQPP GKGLEWIGYIYYTGSTNYNPS LKSRVTISVDTSKNQFSLKLSS VTTADTAVYYCARGGRGDGA AFDIWGQGTMVTVSSASTKG PSVFPLAPSSKSTSGGTAALG CLVKDYFPEPVTVSWNSGALT SGVHTFPAVLQSSGLYSLSSV VTVPSSSLGTQTYICNVNHKP SNTKVDKKVEPKSCDKTHTCP PCPAPELLGGPSVFLFPPKPK DTLMISRTPEVTCVVVDVSHE DPEVKFNWYVDGVEVHNAKT KPREEQYNSTYRVVSVLTVLH QDWLNGKEYKCKVSNKALPA PIEKTISKAKGQPREPQVYTLP PSREEMTKNQVSLTCLVKGFY PSDIAVEWESNGQPENNYKT TPPVLDSDGSFFLYSKLTVDK SRWQQGNVFSCSVMHEALH NHYTQKSLSLSPGK | SEQ ID 1641 | DVVMTQSPDSLAVSLGERATINC KSSQSVLYSSNNKNYLAWYQQK PGQPPKLLIYWASTRESGVPDRF SGSGSGTDFTLTISSLQAEDVAV YYCQQYSSTPYTFGQGTKLEIK RTVAAPSVFIFPPSDEQLKSGTA SVVCLLNNFYPREAKVQWKVDN ALQSGNSQESVTEQDSKDSTYS LSSTLTLSKADYEKHKVYACEVT HQGLSSPVTKSFNRGEC |
| SEQ ID 1534 | QVQLVQSGGGVVQPGRSLRL SCAASGFTFSSSAMHWRQA PGKGLEWVAMIWHDESKKYY ADSVKGRFTISRDNSKNTLYL QMNSLRAEDTAVYYCARPPD GGNSGRWYFDLWGRGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1642 | DIVMTHTPLSLSVTPGQPASISCK SSQSLLGGDGKTYLYWYLQKPG QPPQLLLYEVSNRFSGVPDRFS SGAATDFTLKISRVEAEDVGVYY CMQSTQFPWTFGQGTKVEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1535 | QMQLVQSGGGLVQPGGSLRL SCAASGFTFSSYAMSWRQA PGKGLEWSAISGSGGSTYY ADSVKGRFTISRDNSKNTLYL QMNSLRAEDTAVYYCAKDKN VRKHDYGDHPYGGYFDYWG QGTLVTVSSASTKGPSVFPLA PSSKSTSGGTAALGCLVKDYF PEPVTVSWNSGALTSGVHTF PAVLQSSGLYSLSSVVTVPSS SLGTQTYICNVNHKPSNTKVD KKVEPKSCDKTHTCPPCPAPE LLGGPSVFLFPPKPKDTLMISR TPEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ | SEQ ID 1643 | ETTLTQSPGTLSLSAGERATLSC RASQSVSSSYLAWYQQKPGQAP RLLIYAASYRATGIPDRFSGRGS GTEFTLTISSLQSEDFAVYYCQQ YNNWPPITFGQGTRLEIKRTVAA PSVFIFPPSDEQLKSGTASVVCLL NNFYPREAKVQWKVDNALQSGN SQESVTEQDSKDSTYSLSSTLTL SKADYEKHKVYACEVTHQGLSS PVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GNVFSCSVMHEALHNHYTQK
SLSLSPGK | | |
| SEQ ID 1536 | EVQLVQSGAEVKKPGASVKV
SCKASGYTFTSYAMHWVRQA
PGQRLEWMGWINAGNGNTK
YSQKFQGRVTITRDTSASTAY
MELSSLRSEDTAVYYCARVA
GATSLWYWGQGTLVTVSSAS
TKGPSVFPLAPSSKSTSGGTA
ALGCLVKDYFPEPVTVSWNS
GALTSGVHTFPAVLQSSGLYS
LSSVVTVPSSSLGTQTYICNV
NHKPSNTKVDKKVEPKSCDK
THTCPPCPAPELLGGPSVFLF
PPKPKDTLMISRTPEVTCVVV
DVSHEDPEVKFNWYVDGVEV
HNAKTKPREEQYNSTYRVVS
VLTVLHQDWLNGKEYKCKVS
NKALPAPIEKTISKAKGQPREP
QVYTLPPSREEMTKNQVSLTC
LVKGFYPSDIAVEWESNGQPE
NNYKTTPPVLDSDGSFFLYSK
LTVDKSRWQQGNVFSCSVMH
EALHNHYTQKSLSLSPGK | SEQ ID 1644 | DVVMTQSPATLSVSPGERATLSC
RASQSVSSNLAWYQQKPGQAPR
LLIYDASTRATGIPARFSGSGSGT
EFTLTISSLQSEDFAVYYCQHYN
NWPHTFGQGTKLEIKRTVAAPSV
FIFPPSDEQLKSGTASVVCLLNNF
YPREAKVQWKVDNALQSGNSQE
SVTEQDSKDSTYSLSSTLTLSKA
DYEKHKVYACEVTHQGLSSPVTK
SFNRGEC |
| SEQ ID 1537 | QVQLQQSGPGLVKPSQSLSL
TCAISGDSVSSNSAAWNWIR
QSPSRGLEWLGRTYYRSKWY
NDYAVSVKSRITIKPDTSKNQF
SLQLNSVTPEDTAVYYCTRLA
NSDGVDVWGQGTMVTVSSA
STKGPSVFPLAPSSKSTSGGT
AALGCLVKDYFPEPVTVSWN
SGALTSGVHTFPAVLQSSGLY
SLSSVVTVPSSSLGTQTYICN
VNHKPSNTKVDKKVEPKSCD
KTHTCPPCPAPELLGGPSVFL
FPPKPKDTLMISRTPEVTCVV
VDVSHEDPEVKFNWYVDGVE
VHNAKTKPREEQYNSTYRVV
SVLTVLHQDWLNGKEYKCKV
SNKALPAPIEKTISKAKGQPRE
PQVYTLPPSREEMTKNQVSLT
CLVKGFYPSDIAVEWESNGQ
PENNYKTTPPVLDSDGSFFLY
SKLTVDKSRWQQGNVFSCSV
MHEALHNHYTQKSLSLSPGK | SEQ ID 1645 | ETTLTQSPGTLSLSPGERATLSC
RASQSVSSNLAWYQQKPGQAP
RLLIYGASSRASGIPDRENGSGS
GTDFTLTINRLEPEDFAVYYCQQ
YGNSQTFGQGTRLEIKRTVAAPS
VFIFPPSDEQLKSGTASVVCLLNN
FYPREAKVQWKVDNALQSGNSQ
ESVTEQDSKDSTYSLSSTLTLSK
ADYEKHKVYACEVTHQGLSSPVT
KSFNRGEC |
| SEQ ID 1538 | QVQLQQSGPGLVKPSQTLSL
TCAISGDSVSSDSAVWTWIRQ
SPSRGLEWLGRTYYKSKWYN
DYAASVKSRITINPDTSKNQFS
LHLNSVTPEDTAVYYCARGVT
RTFDYWGQGTTVTVSSASTK
GPSVFPLAPSSKSTSGGTAAL
GCLVKDYFPEPVTVSWNSGA
LTSGVHTFPAVLQSSGLYSLS
SVVTVPSSSLGTQTYICNVNH
KPSNTKVDKKVEPKSCDKTHT
CPPCPAPELLGGPSVFLFPPK
PKDTLMISRTPEVTCVVVDVS
HEDPEVKFNWYVDGVEVHNA
KTKPREEQYNSTYRVVSVLTV
LHQDWLNGKEYKCKVSNKAL
PAPIEKTISKAKGQPREPQVYT
LPPSREEMTKNQVSLTCLVKG
FYPSDIAVEWESNGQPENNY
KTTPPVLDSDGSFFLYSKLTV
DKSRWQQGNVFSCSVMHEA
LHNHYTQKSLSLSPGK | SEQ ID 1646 | DVVMTQSPATLSVSPGERATLSC
RASQSVSSNLAWYQQKPGQAPR
LLIYGASTRATGIPARFSGSGSGT
EFTLTISSLQSEDFAVYYCQQYN
NWPRTFGQGTKLEIKRTVAAPSV
FIFPPSDEQLKSGTASVVCLLNNF
YPREAKVQWKVDNALQSGNSQE
SVTEQDSKDSTYSLSSTLTLSKA
DYEKHKVYACEVTHQGLSSPVTK
SFNRGEC |
| SEQ ID 1539 | QLQLQESGPGLVKPSQTLSLT
CAISGDSVSSNSAAWNWIRQ
SPSRGLEWLGRTYYRSKWYN | SEQ ID 1647 | DVVMTQSPLSLPVTLGQPASISC
RSSQSLVYSDGNTYLNWFQQRP
GQSPRRLIYKVSNRDSGVPDRFS |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | DYAVSVKSRITINPDTSKNQFS LQLNSVTPEDTAVYYCAEGN GPFDPWGQGTLVTVSSASTK GPSVFPLAPSSKSTSGGTAAL GCLVKDYFPEPVTVSWNSGA LTSGVHTFPAVLQSSGLYSLS SVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | | GSGSGTDFTLKISRVEAEDVGVY YCMQGTHWPRTFGGGTKLEIKR TVAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1540 | QITLKESGGGVVQPGRSLRLS CVASGFTFSTYPMHWRQAP GKGLEWVAVISYDGRNEYYA DSVKGRFTISRDNSKNTLYLQ MNSLRAEDTAVYYCATRDTPL VGVSIYWGQGTLVTVSSASTK GPSVFPLAPSSKSTSGGTAAL GCLVKDYFPEPVTVSWNSGA LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | SEQ ID 1648 | DIQMTQSPSTLSASVGDRVTITC RASQSISRWLAWYQQKPGKAPK LLIYKASTIKSGVPSRFSASGSGT EFTLTISSLQPEDFATYYCQHYKS DSRTFGQGTKVEIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1541 | QMQLVQSGGGLVKAGGSLRL SCSASGFTFSSYAMHWRQA PGKGLEYVSAISSNGGSTYYA DSVKGRFTISRDNSKNTLYLQ MSSLRAEDTAVYYCVNRAGY GDYRHFQHWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1649 | DVVMTQSPSSLAASVGDRITITC RPSQDIGTYLNWYQQKAGEAPK LLIYAASNLHSGVSSRFRGVGSG TQFTLTISSLQPEDFATYYCHQSY GPRTFGQGTKLEIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1542 | EVQLVQSGGGVVQPGGSLRL SCAASGFTFSSYGMHWRQA PGKGLEWVAFISYDGSNKYYA DSVKGRFTISRDNSKNTLYLQ MNSLRAEDTAVYYCATTGDR FQEFDYWGQGTLVTVSSAST KGPSVFPLAPSSKSTSGGTAA LGCLVKDYFPEPVTVSWNSG | SEQ ID 1650 | ETTLTQSPATLSVSPGERATLSC RASQVSSNLAWYQQKPGQAPR LLIYGASTRATGIPARFSGSGSGT EFTLTISSLQSEDFAVYYCQQYN NWPPITFGQGTRLEIKRTVAAPS VFIFPPSDEQLKSGTASVVCLLNN FYPREAKVQWKVDNALQSGNSQ ESVTEQDSKDSTYSLSSTLTLSK |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | | ADYEKHKVYACEVTHQGLSSPVT KSFNRGEC |
| SEQ ID 1543 | QMQLVQSGGVLLQPGRSLRL SCTASGFTFAAYNINWFRQGP GGGLEWVGFIRANADSGTTE YAASVKGRFFISRDDSRSTAY LQMTSLKTEDTAVYYCARDD RGRGDDFDYWGQGTLVTVSS ASTKGPSVFPLAPSSKSTSGG TAALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1651 | DVVMTQSPGTLSLSPGERATLSC RASQSVSSSYLAWYQQKPGQAP RLLIYGASSRATGIPDRFSGSGS GTDFTLTISRLEPEDFAVYYCQQ YGSSGYTFGQGTKLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1544 | QVQLVQSGGGLVQPGGSLRL SCAASGFTFSSYGMTWVRQA PGKGLEWSTISGNGVGTYY PDSVKDRFTISRDSSKNTVYL QMNSLRAEDTAVYYCVKHGR AGINWYFDLWGRGTLVTVSS ASTKGPSVFPLAPSSKSTSGG TAALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1652 | ETTLTQSPGTLSLSPGERATLSC RASQSVSSSYLAWYQQKPGQAP RLLIYGASSRATGIPDRFSGSGS GTDFTLTISRLEPEDFAVYYCQQ YGSSFGQGTRLEIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1545 | QVQLQQSGPGLVKPSQTLSL TCAISGDSVSSNSAAWNWIR QSPSRGLEWLGRTYYRSKWY NDYAVSVKSRITINPDTSKNQF SLQLNSVTPEDTAVYYCARG GGLWAFDIWGQGTTVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE | SEQ ID 1653 | EIVLTQSPSTLSASVGDRVTITCR ASQSISSCLAWYQQKPGKAPKLL IYAASTLQSGVPSRFSGSGSGTE FTLTISTLQPEDFATYYCQQLNSY PQTFGQGTKVDIKRTVAAPSVFIF PPSDEQLKSGTASVVCLLNNFYP REAKVQWKVDNALQSGNSQESV TEQDSKDSTYSLSSTLTLSKADY EKHKVYACEVTHQGLSSPVTKSF NRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | | |
| SEQ ID 1546 | EVQLVQSGAEVKKPGASVKV SCKASGYTFTGYYMHWVRQA PGQGLEWMGWINPNSGGTN YAQKFQGRVTMTRDTSISTAY MELSRLRSDDTAVYYCARDKI GSCPYWGQGTLVTVSSASTK GPSVFPLAPSSKSTSGGTAAL GCLVKDYFPEPVTVSWNSGA LTSGVHTFPAVLQSSGLYSLS SWVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | SEQ ID 1654 | DIVMTHTPLSLSVTPGQPASISCK SSQSLLHSDGKTYLYWYLQKPG QPPQLLIYEVSNRFSGVPDRFSG SGSGTDFTLKISRVEAEDVGVYY CMQSIQLPLTFGGGTKVEIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |
| SEQ ID 1547 | QVTLKESGPTLVKPTQTLTLT CTFSGFSLSTSGVGVGWIRQ PPGKALEWLALIYWDDDKRYS PSLKSRLTITKDTSKNQVVLTM TNMDPVDTATYYCAHRPDSS SQCFDYWGQGTLVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | SEQ ID 1655 | DVVMTQSPGTLSLSPGERATLSC RASQSVSSSYLAWYQQKPGQAP RLLIYGASSRATGIPDRFSGSGS GTDFTLTISRLEPEDFAVYYCQQ YNNWPLTFGGGTKLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1548 | QVTLKESGGGVVQPGRSLRL SCAASGFTFSSYAMHWVRQA PGKGLEWVAVISYDGSNKYY ADSVKGRFTISRDNSKNTLYL QMNSLRAEDTAVYYCARSSG WSLPEDYWGQGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK | SEQ ID 1656 | DIQLTQSPDSLAVSLGERATINCT SSQSVLYSSNNKNYIAWYQQKP GQPPKLLIYWASTRESGVPDRFS GSGSGTDFTLTISSLQAEDVAVY YCQQYYYIPRTFGQGTKVEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | LTVDKSRWQQGNVFSCSVMH EALHNHYTQKSLSLSPGK | | |
| SEQ ID 1549 | QVQLVQSGAEVKKPGASVKV SCKVSGYTLTELSMHWRQA PGKGLEWMGGFDPEDGETIY AQKFQGRVTMTEDTSTDTAY MELSSLRSEDTAVYYCATDVN PELLGAGFDYWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1657 | DVVMTQSPLSLPVTPGEPASISC RSSQSLLHSNGYNYLDWYLQKP GQSPQLLIYLGSNRAPGVPDRFS GSGSGTDFTLKISRVEAEDVGVY YCMQALQTRTFGQGTKLEIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |
| SEQ ID 1550 | QVTLKESGGGLVQPGGSLRL SCAASGFTFSDQYMDWVRQA PGKGLEWVGRVRNKANSYTT EYAASVKGRFTISRDDSKNSL YLQMNSLNTEDTAMYFCASSL NSGGYRCFHHWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1658 | ETTLTQSPGTLSLSPGERATLSC RASQSLTSSYLAWYQQKPGQAP RLLIYRASSRATGIPDRFSGSGS GTDFTLTISRLEPEDFAVYYCQQ YGSSPNTFGQGTRLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1551 | QVQLVQSGGGLVQPGGSLRL SCSASGFTFSSYAMHWRQA PGKGLEYVSAISSNGGSTYYA DSVKGRFTISRDNSKNTLYLQ MSSLRAEDTAVYYCVKAPRG VVPAAMRGGYWGQGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1659 | EIVLTQSPLSLPVTLGQPASISCR SSQSLVHSNGHTYLSWFQQRPG QSPRRLIYEVSNRDSGVPDRFSG SGSGTDFTLRISRVEAEDVGVYY CLQGTHWPPLTVGGGTKVDIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1552 | QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1660 | DVVMTQSPATLSLSPGERATLSCRASQSVGSDLAWYQQKPGQAPRLLIYRASTRAAGIPARFSGSGSGTDFTLTISRLEPEDFAVFYCQQYGRSPYTSGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1553 | QVQLQQWGAGLLKPSETLSLTCAVYGGSFSGYYWSIRQPPGKGLEWIGEINHSGSTNYNPSLKSRVTISVDTSKNQFSLKLSSVTAADTAVYYCARGRSLPYRGLAPRSFGGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1661 | DIVMTHTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1554 | QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 1662 | EIVMTQSPLSLSVTPGEPASISCRSSQSLLHSSGYNYLDWYLQKPGQSPQLLIYLGSTRASGVPDRFSGSGSGTDFTLKISRVEAEDVGVYYCMQGLQIPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID 1555 | QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGM | SEQ ID 1663 | DIVMTHTPLSLSVTPGQPASISCKSSQSLLHSDGKTYLYWLQKPGQPPQLLIYEVSNRFSGVPDRFSGSGSGTDFTLKISRVEAEDVGVYYCMQSIQLPWTFGQGTKVEIKRTV |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | YYYGSGSSYFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | | AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |
| SEQ ID 1556 | QVQLVQSGGGLVQPGGSLRL SCAASGFTFSSYAMSWRQA PGKGLEWVSGISGSGGSTYY ADSVKGRFTISRDNSKNMLFL QMNSPRAEDTAVYYCAKKIAA AGKQPVDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1664 | ETTLTQSPATLSVSPGERATLSC RASQSVSSNLAWYQQKPGQAPR LLIYGASTRATGIPARFSGSGSGT EFTLTISSLQSEDFAVYYCQQYN NWPRFGQGTRLEIKRTVAAPSVF IFPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1557 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARRKVYDYV WGSYRLPGSVSYYFDYWGQ GTLVTVSSASTKGPSVFPLAP SSKSTSGGTAALGCLVKDYFP EPVTVSWNSGALTSGVHTFP AVLQSSGLYSLSSVVTVPSSS LGTQTYICNVNHKPSNTKVDK KVEPKSCDKTHTCPPCPAPEL LGGPSVFLFPPKPKDTLMISR TPEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | SEQ ID 1665 | DVVMTQSPSTLSASVGDRVTITC RASQTINSWLAWYQQKPGKAPK LLISRASRLESGVPSRFSGSASG TEYILTINSLQPDDFAMYFCHQYN SYSPTFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1558 | QVQLVQSGAEVKKPGESLKIS CKGSGYSFTSYWIGWVRQMP GKGLEWMGIIYPGDSDTRYSP SFQGQVTISADKSISTAYLQW SSLKASDTAMYYCARLPGRA ARPDYWGQGTLVTVSSASTK GPSVFPLAPSSKSTSGGTAAL GCLVKDYFPEPVTVSWNSGA | SEQ ID 1666 | ETTLTQSPGTLSLSPGERATLSC RASQSVSSSYLAWYQQKPGQAP RLLIYGASSRATGIPARFSGSGS GTDFTLTISSLEPEDFAVYYCQQ RYNWPITFGQGTRLEIKRTVAAP SVFIFPPSDEQLKSGTASVVCLLN NFYPREAKVQWKVDNALQSGNS QESVTEQDSKDSTYSLSSTLTLS |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | | KADYEKHKVYACEVTHQGLSSP VTKSFNRGEC |
| SEQ ID 1559 | QVTLKESGGGVVQPGRSLRL SCAASGFTFSSYAMHWRQA PGKGLEWAVISYDGSNKYY ADSVKGRFTISRDNSKNTLYL QMNSLRAEDTAVYYCARGPG AVAGTKPKYYFDYWGQGTLV TVSSASTKGPSVFPLAPSSKS TSGGTAALGCLVKDYFPEPVT VSWNSGALTSGVHTFPAVLQ SSGLYSLSSVVTVPSSSLGTQ TYICNVNHKPSNTKVDKKVEP KSCDKTHTCPPCPAPELLGGP SVFLFPPKPKDTLMISRTPEVT CVVVDVSHEDPEVKFNWYVD GVEVHNAKTKPREEQYNSTY RVVSVLTVLHQDWLNGKEYK CKVSNKALPAPIEKTISKAKGQ PREPQVYTLPPSREEMTKNQ VSLTCLVKGFYPSDIAVEWES NGQPENNYKTTPPVLDSDGS FFLYSKLTVDKSRWQQGNVF SCSVMHEALHNHYTQKSLSLS PGK | SEQ ID 1667 | EIVLTQSPATLSLSPGETATLSCR ASQTIGPKSFGWYQQRPGQAPR LLIYDSNRATGIPARFSGSGSGTD FTLTISSLEPEDFAVYYCQQRSR WPLTFGPGTKVDIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1560 | EVQLVQSGGGVVQPGRSLRL SCAASGFTFSSYAMHWRQA PGKGLEWAVISYDGSNKYY ADSVKGRFTISRDNSKNTLYL QMNSLRAEDTAVYYCARATY YYDSSGYRFDYWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1668 | DVVMTQSPLSLPVTLGQPASISC RSSQSLVYSDGNTYLYWFQQRA GQSPRRLIYKVSKRDSGVPDRFS GSGSGTDFTLKISRVEAEDVGIYY CVQGRHWPYTLGQGTKLEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1561 | EVQLVQSGGGLVEPGGSLRL SCAASRFTFSDAWMSWVRQ APGKGLEWVGRIKSKISGGTT DYAAPVQGRFTISRDDSKNTL YLQMDSLKTEDTAVYYCANR NLGYWGQGTLVTVSSASTKG PSVFPLAPSSKSTSGGTAALG CLVKDYFPEPVTVSWNSGALT SGVHTFPAVLQSSGLYSLSSV VTVPSSSLGTQTYICNVNHKP SNTKVDKKVEPKSCDKTHTCP PCPAPELLGGPSVFLFPPKPK DTLMISRTPEVTCVVVDVSHE | SEQ ID 1669 | EIVLTQSPGTLSLSPGERATLSCR ASQSVSSSYLAWYQQKPGQAPR LLIYDASNRATGIPARFSGSGSGT EFTLTISSLQPDDFATYYCQQYN SYSRTFGQGTKVDIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | DPEVKFNWYVDGVEVHNAKT KPREEQYNSTYRVVSVLTVLH QDWLNGKEYKCKVSNKALPA PIEKTISKAKGQPREPQVYTLP PSREEMTKNQVSLTCLVKGFY PSDIAVEWESNGQPENNYKT TPPVLDSDGSFFLYSKLTVDK SRWQQGNVFSCSVMHEALH NHYTQKSLSLSPGK | | |
| SEQ ID 1562 | EVQLVQSGAEVKKPGASVKV SCKASGYTFTSYAMHWVRQA PGQRLEWMGWINAGNGNTK YSQKFQGRVTMTTDTSTSTA YMELRSLRSDDTAVYYCARA RYYDSSGYIAPSGYFDYWGQ GTLVTVSSASTKGPSVFPLAP SSKSTSGGTAALGCLVKDYFP EPVTVSWNSGALTSGVHTFP AVLQSSGLYSLSSVVTVPSSS LGTQTYICNVNHKPSNTKVDK KVEPKSCDKTHTCPPCPAPEL LGGPSVFLFPPKPKDTLMISR TPEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | SEQ ID 1670 | DVVMTQSPSTLSASVGDRVTITC RASQSITTWLAWSQQQPGKAPK LLIYKASSLTSGVPSRFSGSGSG TEFTLTISSLQPDDFASYYCHHYN GASRMFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1563 | QVQLVQSGAEVKKPGASVKV SCKASGYTFTSYAMHWVRQA PGQRLEWMGWINAGNGNTK YSQKFQGRVTITRDTSASTAY MELSSLRSEDTAVYYCARDG PAVDGAEYFQHWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1671 | ETTLTQSPATLSLSPGERATLSC RASQSVSSYLAWYQQKPGQAPR LLIYDASNRATGIPARFSGSGSGT DFTLTISSLEPEDFAVYYCQQRS NWPFFGQGTRLEIKRTVAAPSVF IFPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |
| SEQ ID 1564 | QLQLQESGPGLVKPSQTLSLT CAISGDSVSSNSAAWNWIRQ SPSRGLEWLGRTYYRSKWYN DYAVSLKSRITINPDTSKNQFS LQLNSVTPEDTAVYYCASLAS GSPPPGDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT | SEQ ID 1672 | ETTLTQSPATLTLSPGERVTLSC RASQSIGTYVAWYQQKPGQAPR FLIYDSSNRATGIPARFSGSGSGT DFTLTISSLEPEDFAFYYCQQRAE WPLTFGQGTRLEIKRTVAAPSVFI FPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | CLVKGFYPSDIAVEWESNGQ PENNYKTTPPVLDSDGSFFLY SKLTVDKSRWQQGNVFSCSV MHEALHNHYTQKSLSLSPGK | | |
| SEQ ID 1565 | QVTLKESGGGVVQPGRSLRL SCAASGFTFSTYGMHWRQA PGKGLEWVALISYDGSKKYYA NSVKGRFTISRDNSKNTLYLQ MKSLRAEDTAMYYCAKGPIVG ATMDYWGQGALVTVSSASTK GPSVFPLAPSSKSTSGGTAAL GCLVKDYFPEPVTVSWNSGA LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | SEQ ID 1673 | DVVMTQSPGTLSLSPGERATLSC RASQSVNSGYLAWYQQKPGQP PRLLISGVSTRATGIPDRFSGSGS GTDFTLTISRLEPEDFAVYYCQEY GNSAMYNFGQGTKLEIKRTVAAP SVFIFPPSDEQLKSGTASVVCLLN NFYPREAKVQWKVDNALQSGNS QESVTEQDSKDSTYSLSSTLTLS KADYEKHKVYACEVTHQGLSSP VTKSFNRGEC |
| SEQ ID 1566 | EVQLVQSGAEVKKPGSSVKV SCKASGGTFSSYAISWVRQA PGQGLEWMGWISAYNGNTN YAQKLQGRVTMTTDTSTSTAY MELRSLRSDDTAVYYCARWY GDYGLDYWGQGTLVTVSSAS TKGPSVFPLAPSSKSTSGGTA ALGCLVKDYFPEPVTVSWNS GALTSGVHTFPAVLQSSGLYS LSSVVTVPSSSLGTQTYICNV NHKPSNTKVDKKVEPKSCDK THTCPPCPAPELLGGPSVFLF PPKPKDTLMISRTPEVTCVVV DVSHEDPEVKFNWYVDGVEV HNAKTKPREEQYNSTYRVVS VLTVLHQDWLNGKEYKCKVS NKALPAPIEKTISKAKGQPREP QVYTLPPSREEMTKNQVSLTC LVKGFYPSDIAVEWESNGQPE NNYKTTPPVLDSDGSFFLYSK LTVDKSRWQQGNVFSCSVMH EALHNHYTQKSLSLSPGK | SEQ ID 1674 | ETTLTQSPATLSVSPGERATLSC RASQSVSSNLAWYQQKPGQAPR LLIYGASTRATGIPARFSGSGSGT EFTLTISSLQSEDFAVYYCQQYN NWPPFTFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1567 | EVQLVQSGAEVKKPGASVKV SCKASGYTFTSYAMHWVRQA PGQRLAWMGWINAGNGNTK YSEKFEGRVTITRDTSASTAY MELSSLRSEDTAVYYCARVAK YYYESGGYRASNWFDPWGQ GTLVTVSSASTKGPSVFPLAP SSKSTSGGTAALGCLVKDYFP EPVTVSWNSGALTSGVHTFP AVLQSSGLYSLSSVVTVPSSS LGTQTYICNVNHKPSNTKVDK KVEPKSCDKTHTCPPCPAPEL LGGPSVFLFPPKPKDTLMISR TPEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | SEQ ID 1675 | DVVMTQSPGTLSLSPGERATLSC RASQSVSSSYLGWYQQKSGQAP RLLIYGASSRATDIPDRFSGSGS GTDFTLTISKLEAEDSAVYYCQQ YGISPLAFGQGTKLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1568 | QVQLQESGPGLVKPSQTLSLT CAISGDSVSSNSAAWNWIRQ SPSRGLEWLGRTYYRSKWYN DYAVSVKSRITINPDTSKNQFS LQLNSVTPEDTAVYYCARAPP PTVGWYAPVFDYWGQGTLVT VSSASTKGPSVFPLAPSSKST SGGTAALGCLVKDYFPEPVTV SWNSGALTSGVHTFPAVLQS SGLYSLSSVVTVPSSSLGTQT YICNVNHKPSNTKVDKKVEPK SCDKTHTCPPCPAPELLGGPS VFLFPPKPKDTLMISRTPEVTC VVVDVSHEDPEVKFNWYVDG VEVHNAKTKPREEQYNSTYR VVSVLTVLHQDWLNGKEYKC KVSNKALPAPIEKTISKAKGQP REPQVYTLPPSREEMTKNQV SLTCLVKGFYPSDIAVEWESN GQPENNYKTTPPVLDSDGSF FLYSKLTVDKSRWQQGNVFS CSVMHEALHNHYTQKSLSLSP GK | SEQ ID 1676 | ETTLTQSPATLSVSPGERATLSC RASQSISNNLAWYQQKPGQAPR LLIYGTSTRATGIPARFSGSGSGT EFTLTISSLQSEDFAVYYCQQYN FWPSITFGQGTRLEIKRTVAAPSV FIFPPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1569 | QLQLQESGGGLVQPGGSLRL SCSASGISFRDYWMHWIRQT PGKGLVWVSRINPDGSSTSY ADSVKGRFTISRDNSKNTLYL QMNSLRAEDTAVYYCAKVTG RRVGAHDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRWV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1677 | ETTLTQSPGTLSLSPGERATLSC RASQSVSSSSLAWYQQKPGQAP RLLIYGASSRATGIPDRFSGSGS GTDPFTLTISRLEPEDFAVYYCQQ YGSSQTFGQGTRLEIKRTVAAPS VFIFPPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1570 | QVQLVQSGAEVKKPGASVKV SCKASGYTFTGYYMHWVRQA PGQGLEWMGWINPNSGGTN YAQKFQGRVTMTRDTSISTAY MELSRLRSDDTAVYYCAFAQ PGAETLNFDLWGRGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1678 | DVVMTQSPLSLPVSLGQPASISC RSNQSLVYSDGGTYLNWFQQRA GQSPRRLVYKVSNRDSGVPDRF SGSGSGTDFTLRISRVEAEDVGV YYCMQGTHWPYTFGQGTKLEIK RTVAAPSVFIFPPSDEQLKSGTA SVVCLLNNFYPREAKVQWKVDN ALQSGNSQESVTEQDSKDSTYS LSSTLTLSKADYEKHKVYACEVT HQGLSSPVTKSFNRGEC |
| SEQ ID 1571 | QVQLQQSGPGLVKPSQTLSL TCAISGDSVSSKSAAWNWIRQ SPSRGLEWLGRTYYRSKWNN DYALSVKSRITINPDTSKNQFS LQLKSVTPEDTALYYCVRQVA | SEQ ID 1679 | DIQLTQSPSSLSASVGDRVTVTC RASQSISSYLNWYQQKPGKAPQ LLIYDASNLETGVPSRFSGSGSG TDFTFTISSLQPEDFATYYCQQF DNVPVTFGGGTKVEIKRTVAAPS |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GGMDVWGQGTTVTVSSASTK GPSVFPLAPSSKSTSGGTAAL GCLVKDYFPEPVTVSWNSGA LTSGVHTFPAVLQSSGLYSLS SVVTVPSSSLGTQTYICNVNH KPSNTKVDKKVEPKSCDKTHT CPPCPAPELLGGPSVFLFPPK PKDTLMISRTPEVTCVVVDVS HEDPEVKFNWYVDGVEVHNA KTKPREEQYNSTYRVVSVLTV LHQDWLNGKEYKCKVSNKAL PAPIEKTISKAKGQPREPQVYT LPPSREEMTKNQVSLTCLVKG FYPSDIAVEWESNGQPENNY KTTPPVLDSDGSFFLYSKLTV DKSRWQQGNVFSCSVMHEA LHNHYTQKSLSLSPGK | | VFIFPPSDEQLKSGTASVVCLLNN FYPREAKVQWKVDNALQSGNSQ ESVTEQDSKDSTYSLSSTLTLSK ADYKHKVYACEVTHQGLSSPVT KSFNRGEC |
| SEQ ID 1572 | QVQLVQSGGGLVQPGRSLRL SCTASGFTFGDYAMSWFRQA PGKGLEWVSAISGSGGSTYY ADSVKGRFTISRDNSKNTLYL QMNSLRAEDTAVYYCAKGSV YSGSYYMLIDYWGQGTLVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1680 | EIVLTQSPLSLPVTLGQPASISCR SSQSLVYSDGNTYLNWFQQRPG QSPRRLIYKVSNRDSGVPDRFSG SGSGTDFTLKISRVEAEDVGVYY CMQGTHWPRTFGQGTKLEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1573 | QVQLQQSGPGLVRPSQTLSL TCVISGDSVSSGSAAWNWIR QSPSRGLEWLGRTYYRAKWY NEYAGSVKSRITISPDTSKNQF SLQLNSVTPEDTAVYFCTRQD KDNTRYSGLGVWGQGTTVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1681 | DVVMTQSPATLSVSPGERATLSC RASQSVSSNLAWYQQKPGQAPR LLIYGASSRATGIPDRFSGSGSGT DFTLTINRLEPEDFAVYYCQQYG SSSMYTFGQGTKLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1574 | EVQLVETGGGLVQPGGSLRL SCAASEFTLRNYGVSWRQA PGKGLEWVSGMSGSGYSTYY ADSVKGRFTISRDSSKNTLFL QMDSLRAEDTAIYYCARGPR MWSSGIDAFDIWHGTMVTV SSASTKGPSVFPLAPSSKSTS GGTAALGCLVKDYFPEPVTVS WNSGALTSGVHTFPAVLQSS GLYSLSSVVTVPSSSLGTQTYI CNVNHKPSNTKVDKKVEPKS | SEQ ID 1682 | DVVMTQSPSSLSASVGDSVAITC RASQSISNYLNWYQQRPGKAPK LLIFAASSLQSGVPSRFSGSGSG TDFTLTISSLQPEDFATYSCQQSY ITPWTFGQGTKLEIKRTVAAPSVF IFPPSDEQLKSGTASVVCLLNNFY PREAKVQWKVDNALQSGNSQES VTEQDSKDSTYSLSSTLTLSKAD YEKHKVYACEVTHQGLSSPVTKS FNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | CDKTHTCPPCPAPELLGGPSV<br>FLFPPKPKDTLMISRTPEVTCV<br>VVDVSHEDPEVKFNWYVDGV<br>EVHNAKTKPREEQYNSTYRV<br>VSVLTVLHQDWLNGKEYKCK<br>VSNKALPAPIEKTISKAKGQPR<br>EPQVYTLPPSREEMTKNQVSL<br>TCLVKGFYPSDIAVEWESNGQ<br>PENNYKTTPPVLDSDGSFFLY<br>SKLTVDKSRWQQGNVFSCSV<br>MHEALHNHYTQKSLSLSPGK | | |
| SEQ ID 1575 | QVQLQQWGAGLLKPSETLSL<br>TCAVYGGSVSGYYWSWIRQP<br>PGKGLEWMGEIHHSGSTNYN<br>PSLKSRVTISLDTPKNQFSLKL<br>SSVTAADTAVYYCARRDWAG<br>KRVWGQGTLVTVSSASTKGP<br>SVFPLAPSSKSTSGGTAALGC<br>LVKDYFPEPVTVSWNSGALTS<br>GVHTFPAVLQSSGLYSLSSVV<br>TVPSSSLGTQTYICNVNHKPS<br>NTKVDKKVEPKSCDKTHTCPP<br>CPAPELLGGPSVFLFPPKPKD<br>TLMISRTPEVTCVVVDVSHED<br>PEVKFNWYVDGVEVHNAKTK<br>PREEQYNSTYRVVSVLTVLHQ<br>DWLNGKEYKCKVSNKALPAPI<br>EKTISKAKGQPREPQVYTLPP<br>SREEMTKNQVSLTCLVKGFYP<br>SDIAVEWESNGQPENNYKTT<br>PPVLDSDGSFFLYSKLTVDKS<br>RWQQGNVFSCSVMHEALHN<br>HYTQKSLSLSPGK | SEQ ID 1683 | DVVMTQSPGTLSLSPGERATLSC<br>RASQSVSTLLAWYQQKPGQAPR<br>LLIYDASNRATGIPGRFSASGSGT<br>DFSLTISSLETEDSAVYYCQHRY<br>VWPFTFGGGTKLEIKRTVAAPSV<br>FIFPPSDEQLKSGTASVVCLLNNF<br>YPREAKVQWKVDNALQSGNSQE<br>SVTEQDSKDSTYSLSSTLTLSKA<br>DYEKHKVYACEVTHQGLSSPVTK<br>SFNRGEC |
| SEQ ID 1576 | QVQLQQSGPGLLKPSQTLSLT<br>CAISGDSVSSNTATWNWIRQS<br>PSRGLEWLGRTYYRSKWYKD<br>NALSVKSRITINPDTSKNQFSL<br>QLNSVTPEDTAVYYCAGGRA<br>GIAAFDIWGQGTTVTVSSAST<br>KGPSVFPLAPSSKSTSGGTAA<br>LGCLVKDYFPEPVTVSWNSG<br>ALTSGVHTFPAVLQSSGLYSL<br>SSVVTVPSSSLGTQTYICNVN<br>HKPSNTKVDKKVEPKSCDKT<br>HTCPPCPAPELLGGPSVFLFP<br>PKPKDTLMISRTPEVTCVVVD<br>VSHEDPEVKFNWYVDGVEVH<br>NAKTKPREEQYNSTYRVVSVL<br>TVLHQDWLNGKEYKCKVSNK<br>ALPAPIEKTISKAKGQPREPQV<br>YTLPPSREEMTKNQVSLTCLV<br>KGFYPSDIAVEWESNGQPEN<br>NYKTTPPVLDSDGSFFLYSKL<br>TVDKSRWQQGNVFSCSVMH<br>EALHNHYTQKSLSLSPGK | SEQ ID 1684 | DIQMTQSPSSLSASVGDRVTITC<br>RASQGIRNDLGWYQQKPGKAPK<br>RLIYGASSLQSGVPSRFSGSGSG<br>TEFTLTIRSLQPEDFATYYCLQHN<br>SYPRTFGQGTKVEIKRTVAAPSV<br>FIFPPSDEQLKSGTASVVCLLNNF<br>YPREAKVQWKVDNALQSGNSQE<br>SVTEQDSKDSTYSLSSTLTLSKA<br>DYEKHKVYACEVTHQGLSSPVTK<br>SFNRGEC |
| SEQ ID 1577 | QVQLVQSGGGLIQPGGSLRL<br>SCAASGFTVSSNYMSWVRQA<br>PGKGLEWVSLIYSDGRTNYAD<br>SVKGRFTISRDNSKNTLYLQM<br>NSLRAEDTAVYYCAKGALQG<br>EWRRFDYWGQGTLVTVSSAS<br>TKGPSVFPLAPSSKSTSGGTA<br>ALGCLVKDYFPEPVTVSWNS<br>GALTSGVHTFPAVLQSSGLYS<br>LSSVVTVPSSSLGTQTYICNV<br>NHKPSNTKVDKKVEPKSCDK<br>THTCPPCPAPELLGGPSVFLF<br>PPKPKDTLMISRTPEVTCVVV<br>DVSHEDPEVKFNWYVDGVEV<br>HNAKTKPREEQYNSTYRVVS<br>VLTVLHQDWLNGKEYKCKVS<br>NKALPAPIEKTISKAKGQPREP | SEQ ID 1685 | DVVMTQSPATLSLSPGERATLSC<br>RASQSVSSYLAWYQQKPGQAPR<br>LLIYDASNRATGIPARFSGSGSGT<br>DFTLTISSLEPEDFAVYYCQQRS<br>NWPWTFGQGTKLEIKRTVAAPS<br>VFIFPPSDEQLKSGTASVVCLLNN<br>FYPREAKVQWKVDNALQSGNSQ<br>ESVTEQDSKDSTYSLSSTLTLSK<br>ADYEKHKVYACEVTHQGLSSPVT<br>KSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | QVYTLPPSREEMTKNQVSLTC<br>LVKGFYPSDIAVEWESNGQPE<br>NNYKTTPPVLDSDGSFFLYSK<br>LTVDKSRWQQGNVFSCSVMH<br>EALHNHYTQKSLSLSPGK | | |
| SEQ ID 1578 | QVQLQQSGPGLVKPSQTLSL<br>TCAISGDSVSSNSAAWNWIR<br>QSPSRGLEWLGRTYYRSKWY<br>NDYAVSVKSRITINPDTSKNQF<br>SLQLNSVTPEDTAVYYCTRTN<br>QGYGGNSGVFDYWGQGTLV<br>TVSSASTKGPSVFPLAPSSKS<br>TSGGTAALGCLVKDYFPEPVT<br>VSWNSGALTSGVHTFPAVLQ<br>SSGLYSLSSVVTVPSSSLGTQ<br>TYICNVNHKPSNTKVDKKVEP<br>KSCDKTHTCPPCPAPELLGGP<br>SVFLFPPKPKDTLMISRTPEVT<br>CVVVDVSHEDPEVKFNWYVD<br>GVEVHNAKTKPREEQYNSTY<br>RVVSVLTVLHQDWLNGKEYK<br>CKVSNKALPAPIEKTISKAKGQ<br>PREPQVYTLPPSREEMTKNQ<br>VSLTCLVKGFYPSDIAVEWES<br>NGQPENNYKTTPPVLDSDGS<br>FFLYSKLTVDKSRWQQGNVF<br>SCSVMHEALHNHYTQKSLSLS<br>PGK | SEQ ID 1686 | DVVMTQSPLSLPVTLGQAASISC<br>RSSHSLTTTDGRTYVAWFQQRP<br>GQSPRRLLYEVSKRDSGAPDRF<br>SGSGSGTDFTLKISRVEADDVGI<br>YHCMQGTHGPHTFGQGTKLEIK<br>RTVAAPSVFIFPPSDEQLKSGTA<br>SVVCLLNNFYPREAKVQWKVDN<br>ALQSGNSQESVTEQDSKDSTYS<br>LSSTLTLSKADYEKHKVYACEVT<br>HQGLSSPVTKSFNRGEC |
| SEQ ID 1579 | QVQLQQSGPGLVKPSQTLSL<br>TCAISGDSVSGNSAAWNWIR<br>QSPSRGLEWLGRTYYRSKWY<br>NDYAVSVKSRITINPDTSKNQF<br>SLQLNSVTPEDTAVYYCARIV<br>GGAVDCWGQGTLVTVSSAST<br>KGPSVFPLAPSSKSTSGGTAA<br>LGCLVKDYFPEPVTVSWNSG<br>ALTSGVHTFPAVLQSSGLYSL<br>SSVVTVPSSSLGTQTYICNVN<br>HKPSNTKVDKKVEPKSCDKT<br>HTCPPCPAPELLGGPSVFLFP<br>PKPKDTLMISRTPEVTCVVVD<br>VSHEDPEVKFNWYVDGVEVH<br>NAKTKPREEQYNSTYRVVSVL<br>TVLHQDWLNGKEYKCKVSNK<br>ALPAPIEKTISKAKGQPREPQV<br>YTLPPSREEMTKNQVSLTCLV<br>KGFYPSDIAVEWESNGQPEN<br>NYKTTPPVLDSDGSFFLYSKL<br>TVDKSRWQQGNVFSCSVMH<br>EALHNHYTQKSLSLSPGK | SEQ ID 1687 | ETTLTQSPATLSVSPGERATLSC<br>RASQSVTSNLAWYQQKPGQAPR<br>LLIYGASNRATGIPARFSVSGSGT<br>DFTLTISRLEPEDFAVYYCQQYG<br>SPPPTTFGQGTRLEIKRTVAAPS<br>VFIFPPSDEQLKSGTASVVCLLNN<br>FYPREAKVQWKVDNALQSGNSQ<br>ESVTEQDSKDSTYSLSSTLTLSK<br>ADYEKHKVYACEVTHQGLSSPVT<br>KSFNRGEC |
| SEQ ID 1580 | EVQLVQSGAEVKKPGASVKV<br>SCKASGYTFTSYAMHWVRQA<br>PGQRLEWMGWINAGNGNTK<br>YSQKFQGRVTITRDTSASTAY<br>MELSSLRSEDTAVYYCARVRV<br>GATTVYDSWFDPWGQGTLVT<br>VSSASTKGPSVFPLAPSSKST<br>SGGTAALGCLVKDYFPEPVTV<br>SWNSGALTSGVHTFPAVLQS<br>SGLYSLSSVVTVPSSSLGTQT<br>YICNVNHKPSNTKVDKKVEPK<br>SCDKTHTCPPCPAPELLGGPS<br>VFLFPPKPKDTLMISRTPEVTC<br>VVVDVSHEDPEVKFNWYVDG<br>VEVHNAKTKPREEQYNSTYR<br>VVSVLTVLHQDWLNGKEYKC<br>KVSNKALPAPIEKTISKAKGQP<br>REPQVYTLPPSREEMTKNQV<br>SLTCLVKGFYPSDIAVEWESN | SEQ ID 1688 | DVVMTQSPGTLSLSPGERATLSC<br>RASQSVSSSYLAWYQQKPGQAP<br>RLLIYGASSRATGIPDRFSGSGS<br>GTDFTLTISRLEPEDFAVYYCQQ<br>YGSSRRTFGQGTKLEIKRTVAAP<br>SVFIFPPSDEQLKSGTASVVCLLN<br>NFYPREAKVQWKVDNALQSGNS<br>QESVTEQDSKDSTYSLSSTLTLS<br>KADYEKHKVYACEVTHQGLSSP<br>VTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | GQPENNYKTTPPVLDSDGSF FLYSKLTVDKSRWQQGNVFS CSVMHEALHNHYTQKSLSLSP GK | | |
| SEQ ID 1581 | QVQLVQSGGGLVQPGGSRL SCAASGFTFSSYAMSWVRQA PGKGLEWVSAISGSGGSTYY ADSVKGRFTISRDNSKNTLYL QMNSLRAEDTAVYYCAKDGG SSPYYDSSGLLPWYFDLWGR GTLVTVSSASTKGPSVFPLAP SSKSTSGGTAALGCLVKDYFP EPVTVSWNSGALTSGVHTFP AVLQSSGLYSLSSVVTVPSSS LGTQTYICNVNHKPSNTKVDK KVEPKSCDKTHTCPPCPAPEL LGGPSVFLFPPKPKDTLMISR TPEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | SEQ ID 1689 | ETTLTQSPGTLSLSPGERATLSC RASQSVFNNYLAWYQQRPGQAP RLLIYGASSRATGIPDRFSGGGS GTDFTLTISRLEPEDFAVYCCQQ YGSSPITFGQGTRLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1582 | QVQLQESGGGLVQPGGSRL SCAASGFTFSSYAMHWVRQA PGKGLEYVSAISSNGGSTYYA NSVKGRFTISRDNSKNTLYLQ MGSLRAEDMAVYYCARAKFW TYYFDYWGQGTLVTVSSAST KGPSVFPLAPSSKSTSGGTAA LGCLVKDYFPEPVTVSWNSG ALTSGVHTFPAVLQSSGLYSL SSVVTVPSSSLGTQTYICNVN HKPSNTKVDKKVEPKSCDKT HTCPPCPAPELLGGPSVFLFP PKPKDTLMISRTPEVTCVVVD VSHEDPEVKFNWYVDGVEVH NAKTKPREEQYNSTYRVVSVL TVLHQDWLNGKEYKCKVSNK ALPAPIEKTISKAKGQPREPQV YTLPPSREEMTKNQVSLTCLV KGFYPSDIAVEWESNGQPEN NYKTTPPVLDSDGSFFLYSKL TVDKSRWQQGNVFSCSVMH EALHNHYTQKSLSLSPGK | SEQ ID 1690 | EIVLTQSPATLSLSPGERATLSCR ASQSVSSYLAWYQQKPGQAPRL LIYDASNRATGIPARFSGSGSGT DFTLTISRLEPEDFAVYYCQQYG SSLRYTFGQGTKLEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1583 | QVQLQQWGAGLLKPSETLSL TCAVYGGSFSGYYWSWIRQP PGKGLEWIGEINHSGSTNYNP SLKSRVTISVDTSKNQFSLKLS SVTAADTAVYYCARGGGSGS YYKRFFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1691 | EIVLTQSPDSLAVSLGERATINCK SSQSVLYDSNSKNYLSWYQQKP GQPPKLLISWASTRGSGVPDRFS GSGSGTDFTLTISSLQAEDVAVY YCQQFYGIPHFGQGTRLEIKRTV AAPSVFIFPPSDEQLKSGTASVV CLLNNFYPREAKVQWKVDNALQ SGNSQESVTEQDSKDSTYSLSST LTLSKADYEKHKVYACEVTHQGL SSPVTKSFNRGEC |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| SEQ ID 1584 | EVQLVQSGAEVRKPGASVKV SCKASGYTFTSYAISWVRQAP GQGLEWMGWISAYDGNTNY AQKLQGRVTMTTDTSTSTAY MEVRSLRSDDTAVYYCARDG TVRRVVGATTPGNFDYRGQG TLVTVSSASTKGPSVFPLAPS SKSTSGGTAALGCLVKDYFPE PVTVSWNSGALTSGVHTFPA VLQSSGLYSLSSVVTVPSSSL GTQTYICNVNHKPSNTKVDKK VEPKSCDKTHTCPPCPAPELL GGPSVFLFPPKPKDTLMISRT PEVTCVVVDVSHEDPEVKFN WYVDGVEVHNAKTKPREEQY NSTYRVVSVLTVLHQDWLNG KEYKCKVSNKALPAPIEKTISK AKGQPREPQVYTLPPSREEM TKNQVSLTCLVKGFYPSDIAV EWESNGQPENNYKTTPPVLD SDGSFFLYSKLTVDKSRWQQ GNVFSCSVMHEALHNHYTQK SLSLSPGK | SEQ ID 1692 | DVVMTQSPATLSLSPGERATLSC RASQSVGTNLAWYQQKPGQAP RLLIYDASNRATGIPARFSGSGS GTEFTLTISSLQSEDFAVYYCQQ YNNWPPITFGGGTKLEIKRTVAA PSVFIFPPSDEQLKSGTASVVCLL NNFYPREAKVQWKVDNALQSGN SQESVTEQDSKDSTYSLSSTLTL SKADYEKHKVYACEVTHQGLSS PVTKSFNRGEC |
| SEQ ID 1585 | EVQLVQSGGGVVQPGRSLRL SCAASGFTFSSYGMHWRQA PGKGLEWVAVIWYDGSNKYY ADSVKGRFTISRDNSKNTLYL QMNSLRAEDTAVYYCARDLN RGYCSGGSCFGYWGQGTLV TVSSASTKGPSVFPLAPSSKS TSGGTAALGCLVKDYFPEPVT VSWNSGALTSGVHTFPAVLQ SSGLYSLSSVVTVPSSSLGTQ TYICNVNHKPSNTKVDKKVEP KSCDKTHTCPPCPAPELLGGP SVFLFPPKPKDTLMISRTPEVT CVVVDVSHEDPEVKFNWYVD GVEVHNAKTKPREEQYNSTY RVVSVLTVLHQDWLNGKEYK CKVSNKALPAPIEKTISKAKGQ PREPQVYTLPPSREEMTKNQ VSLTCLVKGFYPSDIAVEWES NGQPENNYKTTPPVLDSDGS FFLYSKLTVDKSRWQQGNVF SCSVMHEALHNHYTQKSLSLS PGK | SEQ ID 1693 | DVVMTQSPLSLPVTLGQPASISC RSSQSLVYSDGNTYLSWLQQRP GQPPRLLIYKISNRFSGVPDRFS GSGAGTDFTLKISRVEAEDVGVY YCMQGTQFPQTFGQGTKLEIKRT VAAPSVFIFPPSDEQLKSGTASV VCLLNNFYPREAKVQWKVDNAL QSGNSQESVTEQDSKDSTYSLS STLTLSKADYEKHKVYACEVTHQ GLSSPVTKSFNRGEC |
| SEQ ID 1586 | QVQLQESGGGLVQPGGSLRL SCAASGFTFSSYAMSWVRQA PGKGLEWVSYISSSGTTIYYA DSVKGRFTVSRDNAKNSLYL QMNSLRAEDTAVYYCARDYS SSGECFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | SEQ ID 1694 | EIVLTQSPGTLSLSPGERATLSCR ASQSVISRYLAWYQQKPGQAPR LLIHGASTRATGIPDRFSGSGSGT DFTLTISRLEPEDFAVYYCQQYG SSPPYTFGQGTKVEIKRTVAAPS VFIFPPSDEQLKSGTASVVCLLNN FYPREAKVQWKVDNALQSGNSQ ESVTEQDSKDSTYSLSSTLTLSK ADYEKHKVYACEVTHQGLSSPVT KSFNRGEC |
| SEQ ID 1587 | EVQLVQSGGGVVQPGRSLRL SCAASGFTFSSYGMHWRQA PGKGLEWVAVIWYDGSNKYY ADSVKGRFTISRDNSKNTLYL | SEQ ID 1695 | DIQLTQSPSTLAASVGDRVTITCR ASQSISSWLAWYQQKPGKAPKV LIYKASSLESGVPSRFSGSGSGT EFTLTISSLQPDDFATYYCQQYN |

TABLE 37-continued

Anti-CLEC2D IgG1 antibody heavy chain and kappa light chain amino acid sequence

| SEQ ID | VH + CH AA_IgG1 | SEQ ID | VK + CK AA |
|---|---|---|---|
| | QMNSLRAEDTAVYYCARDQA AMVGYFDYWGQGTLVTVSSA STKGPSVFPLAPSSKSTSGGT AALGCLVKDYFPEPVTVSWN SGALTSGVHTFPAVLQSSGLY SLSSVVTVPSSSLGTQTYICN VNHKPSNTKVDKKVEPKSCD KTHTCPPCPAPELLGGPSVFL FPPKPKDTLMISRTPEVTCVV VDVSHEDPEVKFNWYVDGVE VHNAKTKPREEQYNSTYRVV SVLTVLHQDWLNGKEYKCKV SNKALPAPIEKTISKAKGQPRE PQVYTLPPSREEMTKNQVSLT CLVKGFYPSDIAVEWESNGQ PENNYKTTPPVLDSDGSFFLY SKLTVDKSRWQQGNVFSCSV MHEALHNHYTQKSLSLSPGK | | SYSGTFGQGTKVEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |
| SEQ ID 1588 | QVTLKESGGGVVQPGRSLRL SCAASGFIFSNYAIHWVRQAP GKGLEWVAVISYDGSNKYYA DSVKGRFTISRDNSKNTLYLQ MNSLRAEDTAVYYCARTFAG YSSKLGYFDLWGRGTLVTVS SASTKGPSVFPLAPSSKSTSG GTAALGCLVKDYFPEPVTVS WNSGALTSGVHTFPAVLQSS GLYSLSSVVTVPSSSLGTQTYI CNVNHKPSNTKVDKKVEPKS CDKTHTCPPCPAPELLGGPSV FLFPPKPKDTLMISRTPEVTCV VVDVSHEDPEVKFNWYVDGV EVHNAKTKPREEQYNSTYRV VSVLTVLHQDWLNGKEYKCK VSNKALPAPIEKTISKAKGQPR EPQVYTLPPSREEMTKNQVSL TCLVKGFYPSDIAVEWESNGQ PENNYKTTPPVLDSDGSFFLY SKLTVDKSRWQQGNVFSCSV MHEALHNHYTQKSLSLSPGK | SEQ ID 1696 | DVVMTQSPAILSVSPGERATLSC RASQSVSSSLAWYQQKPGQPPR LLIYGASTRATAIPARFSGSGSGT EFTLTISSLQSEDFAVYYCQRYD NWPPLFGQGTKLEIKRTVAAPSV FIFPPSDEQLKSGTASVVCLLNNF YPREAKVQWKVDNALQSGNSQE SVTEQDSKDSTYSLSSTLTLSKA DYEKHKVYACEVTHQGLSSPVTK SFNRGEC |

TABLE 38

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| SEQ ID 1697 | GAAGTGCAGCTGGTGCAGTCTGGGG CTGAGGTGAAGAAGCCTGGGGCCTC AGTGAAGGTTTCCTGCAAGGCTTCTG GATACACCTTCACTAGCTATGCTATG CATTGGGTGCGCCAGGCCCCCGGAC AAAGGCTTGAGTGGATGGGATGGAT CAACGCTGGCAATGGTAACACAAAA TATTCACAGAAGTTCCAGGGCAGAG TCACCATTACCAGGGACACATCCGCG AGCACAGCCTACATGGAGCTGAGCA GCCTGAGATCTGAAGACACGGCTGT GTATTACTGTGCGAGAGGCTCCTTGT CCCGAAGTGGCTGGTACGCCGGACT CTTTGACTACTGGGGCCAGGGAACCC TGGTCACCGTCTCCTCAGCATCCACC AAGGGGCCTTCCGTGTTCCCCCTGGC CCCTTCATCCAAGTCGACCTCTGGTG GAACCGCCGCACTCGGTTGCCTGGTC AAAGACTACTTCCCCGAGCCCGTGAC TGTCTCGTGGAACTCGGGCGCCCTCA CATCCGGAGTGCACACCTTTCCCGCC GTGTTGCAGTCCAGCGGCCTGTACAG CCTGAGCTCCGTCGTGACAGTGCCGT | SEQ ID 1805 | GAAACGACACTCACGCAGTCTCCA GCCACCCTATCTGTGTCTCTAGGAG AAAGAGCCACCCTTTCTTGCAGGG CCAGTCAGAGTATTGGCAGCAACT TAGTCTGGTACCAGCTGAAACCTG GCCAGGGTCCCAGGCTCGTCATAT ATAGTGCAACCTCTAGGGCCACTG GAATCCCAGCCAGGTTCAGCGGCA GTGGGTCTGGGACAGAGTTCATTC TCTCCATCAGCAACCTGCAGTCTGA AGATCTTGCAGTTTATTACTGTCAG CAGTATGGTAGTTCACCTCCGACC ACCTTCGGCCAAGGGACACGACTG GAGATTAAACGTACTGTGGCTGCT CCCTCCGTGTTCATTTTTCCTCCGT CGGACGAACAGCTGAAGTCCGGAA CCGCGTCCGTGGTCTGTCTCCTGAA CAACTTCTATCCGCGCGAGGCCGAA AGTCAGTGGAAGGTCGACAACGC ACTGCAGTCGGGAAACTCCCAGGA ATCGGTGACCGAGCAGGACTCGAA GGACTCAACCTACTCATTGTCCTCC ACCCTCACCCTGAGCAAGGCCGAT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CCTCCTCCCTTGGAACCCAGACCTAT ATCTGCAACGTCAATCACAAGCCCTC CAACACCAAAGTGGACAAGAAGGTC GAACCCAAGTCCTGCGACAAGACTC ACACCTGTCCGCCTTGTCCAGCCCCT GAGCTGCTGGGTGGTCCGTCCGTGTT CCTCTTCCCGCCCAAGCCGAAGGACA CTCTGATGATTTCACGCACCCCGGAA GTCACTTGCGTGGTCGTGGACGTGTC GCACGAAGATCCCGAAGTGAAATTC AATTGGTACGTGGATGGGGTCGAAG TGCACAACGCCAAGACCAAGCCTAG GGAAGAACAGTACAACTCTACGTAC CGGGTGGTGTCCGTGCTGACCGTGCT GCACCAGGACTGGCTGAACGGAAAG GAGTACAAGTGCAAAGTGTCAAACA AGGCTCTCCCTGCCCCTATCGAAAAG ACCATCAGCAAGGCCAAGGGTCAAC CTAGGGAGCCCCAGGTCTATACTTTG CCGCCTAGCCGGGAAGAAATGACTA AGAACCAAGTGTCCCTGACTTGCCTT GTCAAGGGCTTTTATCCGTCCGACAT CGCCGTGGAGTGGGAGTCCAACGGA CAACCGGAGAACAACTACAAGACCA CCCCACCGGTGCTCGATTCCGATGGC TCCTTCTTCCTGTACTCCAAGCTGAC TGTGGACAAGTCAAGATGGCAGCAG GGAAACGTGTTCTCCTGCTCCGTGAT GCACGAAGCGCTGCACAACCATTAC ACCCAGAAATCACTGTCACTTTCGCC GGGAAAA | | TACGAGAAGCATAAGGTCTACGCC TGCGAAGTGACCCACCAGGGCCTG AGCAGCCCAGTGACGAAGTCCTTC AACCGGGGAGAATGC |
| SEQ ID 1698 | CAGATCACCTTGAAGGAGTCTGGGG GAGGCGTGGTCCAGCCTGGGAGGTC CCTGAGACTCTCCTGTGCAGCCTCTG GATTCACCTTCAGTAGTTATAGCATG AACTGGGTCCGCCAGGCTCCAGGCA AGGGGCTGCAGTGGGTGGCAATTAT ATCAGATGATGGAAGTAAGAGTTAC TACGCAGACTCCGTGCAGGGCCGATT CACCATCTCCAGAGACAATTCGAGG AACACAGTATTTCTGCAAATGAACA GCCTGAGAGCTGAGGACACGGCTAT GTATTACTGTGCGAGAGACAGGGGA ACTAAATGGAACCAATTGAATGATG TTTTTGATATGTGGGGCCAAGGGACA ATGGTCACCGTCTCTTCAGCATCCAC CAAGGGGCCTTCCGTGTTCCCCCTGG CCCCTTCATCCAAGTCGACCTCTGGT GGAACCGCCGCACTCGGTTGCCTGGT CAAAGACTACTTCCCCGAGCCCGTGA CTGTCTCGTGGAACTCGGGCGCCCTC ACATCCGGAGTGCATACCTTTCCGC CGTGTTGCAGTCCAGCGGCCTGTACA GCCTGAGCTCCGTCGTGACAGTGCCG TCCTCCTCCCTTGGAACCCAGACCTA TATCTGCAACGTCAATCACAAGCCCT CCAACACCAAAGTGGACAAGAAGGT CGAACCCAAGTCCTGCGACAAGACT CACACCTGTCCGCCTTGTCCAGCCCC TGAGCTGCTGGGTGGTCCGTCCGTGT TCCTCTTCCCGCCCAAGCCGAAGGAC ACTCTGATGATTTCACGCACCCCGGA AGTCACTTGCGTGGTCGTGGACGTGT CGCACGAAGATCCCGAAGTGAAATT CAATTGGTACGTGGATGGGGTCGAA GTGCACAACGCCAAGACCAAGCCTA GGGAAGAACAGTACAACTCTACGTA CCGGGTGGTGTCCGTGCTGACCGTGC TGCACCAGGACTGGCTGAACGGAAA GGAGTACAAGTGCAAAGTGTCAAAC AAGGCTCTCCCTGCCCCTATCGAAAA GACCATCAGCAAGGCCAAGGGTCAA CCTAGGGAGCCCCAGGTCTATACTTT GCCGCCTAGCCGGGAAGAAATGACT | SEQ ID 1806 | GAAATTGTGATGACACAGTCTCCA GCCACCCTGTCTTTGTCTCCAGGGG AAAGAGCCACCCTCTCCTGCAGGG CCAGTCAGAGTGTTAGCAGCAGCT ACTTAGCCTGGTACCAGCAAAAAC CTGGCCGGGCTCCCAGGCTCCTCAT CTATGGCGCATCCAACAGGGCCAC AGGCATCCCAGACAGGTTCAGTGG CAGTGGGTCTGGGACAGACTTCAC TCTCATCATCAGCAGACTGGAGCC TGAAGATTTTGCCTTGTATTACTGT CAGCAGTATGGAAGCTCACCGGGA ACGTTCGGCCAAGGGACCAAAGTG GATATCAAACGTACTGTGGCTGCT CCCTCCGTGTTCATTTTTCCTCCGT CGGACGAACAGCTGAAGTCCGGAA CCGCGTCCGTGGTCTGTCTCCTGAA CAACTTCTATCCGCGCGAGGCGAA AGTGCAGTGGAAGGTCGACAACGC ACTGCAGTCGGGAAACTCCCAGGA ATCGGTGACCGAGCAGGACTCGAA GGACTCAACCTACTCATTGTCCTCC ACCCTCACCCTGAGCAAGGCCGAT TACGAGAAGCATAAGGTCTACGCC TGCGAAGTGACCCACCAGGGCCTG AGCAGCCCAGTGACGAAGTCCTTC AACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AAGAACCAAGTGTCCCTGACTTGCCT<br>TGTCAAGGGCTTTTATCCGTCCGACA<br>TCGCCGTGGAGTGGGAGTCCAACGG<br>ACAACCGGAGAACAACTACAAGACC<br>ACCCCACCGGTGCTCGATTCCGATGG<br>CTCCTTCTTCCTGTACTCCAAGCTGA<br>CTGTGGACAAGTCAAGATGGCAGCA<br>GGGAAACGTGTTCTCCTGCTCCGTGA<br>TGCACGAAGCGCTGCACAACCATTA<br>CACCCAGAAATCACTGTCACTTTCGC<br>CGGGAAAA | | |
| SEQ ID 1699 | GAAGTGCAGCTGGTGCAGTCTGGGG<br>CTGAGGTGAAGAAGCCTGGGGCCTC<br>AGTGAAGGTTTCCTGCAAGGCATCTG<br>GATACACCTTCACCAGCTACTATATG<br>CACTGGGTGCGACAGGCCCCTGGAC<br>AAGGGCTTGAGTGGATGGGAATAAT<br>CAACCCTAGTGGTGGTAGCACAAGC<br>TACGCACAGAAGTTCCAGGGCAGAG<br>TCACCATGACCAGGGACACGTCCAC<br>GAGCACAGTCTACATGGAGCTGAGC<br>AGCCTGAGATCTGAGGACACGGCCG<br>TGTATTACTGTGCGAGAGGCCGAGG<br>GTATAGCAGCAGTCGGCTCTACTACT<br>TTGACTACTGGGGCCAGGGAACCCT<br>GGTCACCGTCTCCTCAGCATCCACCA<br>AGGGGCCTTCCGTGTTCCCCCTGGCC<br>CCTTCATCCAAGTCGACCTCTGGTGG<br>AACCGCCGCACTCGGTTGCCTGGTCA<br>AAGACTACTTCCCCGAGCCCGTGACT<br>GTCTCGTGGAACTCGGGCGCCCTCAC<br>ATCCGGAGTGCATACCTTTCCCGCCG<br>TGTTGCAGTCCAGCGGCCTGTACAGC<br>CTGAGCTCCGTCGTGACAGTGCCGTC<br>CTCCCTCCCTTGGAACCCAGACCTATA<br>TCTGCAACGTCAATCACAAGCCCTCC<br>AACACCAAAGTGGACAAGAAGGTCG<br>AACCCAAGTCCTGCGACAAGACTCA<br>CACCTGTCCGCCTTGTCCAGCCCCTG<br>AGCTGCTGGGTGGTCCGTCCGTGTTC<br>CTCTTCCCGCCCAAGCCGAAGGACAC<br>TCTGATGATTTCACGCACCCCGGAAG<br>TCACTTGCGTGGTCGTGGACGTGTCG<br>CACGAAGATCCCGAAGTGAAATTCA<br>ATTGGTACGTGGATGGGGTCGAAGT<br>GCACAACGCCAAGACCAAGCCTAGG<br>GAAGAACAGTACAACTCTACGTACC<br>GGGTGGTGTCCGTGCTGACCGTGCTG<br>CACCAGGACTGGCTGAACGGAAAGG<br>AGTACAAGTGCAAAGTGTCAAACAA<br>GGCTCTCCCTGCCCCTATCGAAAAGA<br>CCATCAGCAAGGCCAAGGGTCAACC<br>TAGGGAGCCCCAGGTCTATACTTTGC<br>CGCCTAGCCGGGAAGAAATGACTAA<br>GAACCAAGTGTCCCTGACTTGCCTTG<br>TCAAGGGCTTTTATCCGTCCGACATC<br>GCCGTGGAGTGGGAGTCCAACGGAC<br>AACCGGAGAACAACTACAAGACCAC<br>CCCACCGGTGCTCGATTCCGATGGCT<br>CCTTCTTCCTGTACTCCAAGCTGACT<br>GTGGACAAGTCAAGATGGCAGCAGG<br>GAAACGTGTTCTCCTGCTCCGTGATG<br>CACGAAGCGCTGCACAACCATTACA<br>CCCAGAAATCACTGTCACTTTCGCCG<br>GGAAAA | SEQ ID 1807 | GATGTTGTGATGACTCAGTCTCCAG<br>CCACCCTGTCTTTGTCTCCAGGGGA<br>AAGAGCCACCCTCTCCTGCAGGGC<br>CAGTCAGAGTGTTAGCAGCTACTT<br>AGCCTGGTACCAACAGAAACCTGG<br>CCAGGCTCCCAGGCTCCTCATCTAT<br>GATGCATCCAACAGGGCCACTGGC<br>ATCCCAGCCAGGTTCAGTGGCAGT<br>GGGTCTGGGACAGACTTCACTCTC<br>ACCATCAGCAGCCTAGAGCCTGAA<br>GATTTTGCAGTTTATTACTGTCAGC<br>AGCGTAGCAACTGGCCTCGGACGT<br>TCGGCCAAGGGACCAAGCTGGAGA<br>TCAAACGTACTGTGGCTGCTCCCTC<br>CGTGTTCATTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |
| SEQ ID 1700 | CAGGTCACCTTGAAGGAGTCTGGGG<br>GAGGCTTGGTCCGGCCTGGAGGGTC<br>CCTGAGACTCTCCTGTGAAGCCTCTG<br>GATTCACCTTCAGTGACCCCTACATG<br>GACTGGGTCCGCCAGGCTCCAGGCA<br>AGGGGCTGGAGTGGGTTGGCCGAAT<br>TACAAATAAGCGTACCGGTTACGCC<br>ACAACATATGCCGCGTCTGTGAAGG | SEQ ID 1808 | GAAATTGTGTTGACGCAGTCTCCA<br>GACTCCCTGGCTGTGTCTCTGGGCG<br>AGAGGGCCACCATCACCTGCAAGT<br>CCAGCCGGAATATTTTATACAGCG<br>GCAACAATAAAAACTTCTTGGCTT<br>GGTATCAGCACAAACCAGGACAGC<br>CTCCTAAGTTGCTCATTTACTGGGC<br>ATCTACCCGGGAATCCGGGGTCCC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACAGATTCACCATCTCAAGAGATGAT<br>TCAAGGAAGTCAGTATATCTGCAAAT<br>GAACAGCCTGAAGACCGAGGACACG<br>GCCGTATATTATTGTGCAACAGATGT<br>CAGTGGGTCCTTCGCGGCCTACGGGG<br>GCCAGGGCACCCTGGTCACCGTCTCC<br>TCAGCATCCACCAAGGGGCCTTCCGT<br>GTTCCCCCTGGCCCCTTCATCCAAGT<br>CGACCTCTGGTGGAACCGCCGCACTC<br>GGTTGCCTGGTCAAAGACTACTTCCC<br>CGAGCCCGTGACTGTCTCGTGGAACT<br>CGGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | TGACCGATTTAGTGGCAGCGGGTC<br>TGGGACAGATTTCACCCTCACCATC<br>AATAGCCTGGAAGCTGAAGATGCT<br>GCAACGTATTACTGTCATCAGAGT<br>AGTAGTTTACCTCACACTTTCGGCC<br>CTGGGACCAAAGTGGATATCAAAC<br>GTACTGTGGCTGCTCCCTCCGTGTT<br>CATTTTTCCTCCGTCGGACGAACAG<br>CTGAAGTCCGGAACCGCGTCCGTG<br>GTCTGTCTCCTGAACAACTTCTATC<br>CGCGCGAGGCGAAAGTGCAGTGGA<br>AGGTCGACAACGCACTGCAGTCGG<br>GAAACTCCCAGGAATCGGTGACCG<br>AGCAGGACTCGAAGGACTCAACCT<br>ACTCATTGTCCTCCACCCTCACCCT<br>GAGCAAGGCCGATTACGAGAAGCA<br>TAAGGTCTACGCCTGCGAAGTGAC<br>CCACCAGGGCCTGAGCAGCCCAGT<br>GACGAAGTCCTTCAACCGGGGAGA<br>ATGC |
| SEQ ID<br>1701 | GAGGTCCAGCTGGTACAGTCTGGGG<br>GAGGCGTGGTCCAGCCTGGGAGGTC<br>CCTGAGACTCTCCTGTGCAGCGTCTG<br>GATTCACCTTCAGTAGCTATGCTATG<br>CATTGGGTGCGCCAGGCCCCCGGAC<br>AAAGGCTTGAGTGGATGGGATGGAT<br>CAACGCTGGCAATGGTAACACAAAA<br>TATTCACAGAAGTTCCAGGGCAGAG<br>TCACCATTACCAGGGACACATCCGCG<br>AGCACAGCCTACATGGAGCTGAGCA<br>GCCTGAGATCTGAAGACACGGCTGT<br>GTATTACTGTGCGGGAGAGGGCGGA<br>GCAGTGGCTGGTACTGTCTACTGGGG<br>CCAGGGAACCCTGGTCACCGTCTCCT<br>CAGCATCCACCAAGGGGCCTTCCGTG<br>TTCCCCCTGGCCCCTTCATCCAAGTC<br>GACCTCTGGTGGAACCGCCGCACTCG<br>GTTGCCTGGTCAAAGACTACTTCCCC<br>GAGCCCGTGACTGTCTCGTGGAACTC<br>GGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA | SEQ ID<br>1809 | GAAACGACACTCACGCAGTCTCCA<br>GGCACCCTGTCTTTGTCTCCAGGGC<br>AAAGAGCCACCCTCTCCTGCAGGG<br>CCAGTGAGAGTGTTAGCAAGAGCT<br>ACTTACTCTGGTACCAGCAGAAAC<br>CTGGCCAGGCTCCCAGACTCCTCAT<br>CTATGGTGCATCCACCAGGGCCAG<br>TGGCATCCCAAACAGGTTCAGTGG<br>CAGTGGGTCTGGGACAGACTTCAC<br>TCTCACCATCAGCAGACTGGAGCC<br>TGAAGATTCTGCAGTGTATTACTGT<br>CAGCACTATGGCAGCTCTCGCACC<br>TTCGGCCAAGGGACACGACTGGAG<br>ATTAAACGTACTGTGGCTGCTCCCT<br>CCGTGTTCATTTTTCCTCCGTCGGA<br>CGAACAGCTGAAGTCCGGAACCGC<br>GTCCGTGGTCTGTCTCCTGAACAAC<br>TTCTATCCGCGCGAGGCGAAAGTG<br>CAGTGGAAGGTCGACAACGCACTG<br>CAGTCGGGAAACTCCCAGGAATCG<br>GTGACCGAGCAGGACTCGAAGGAC<br>TCAACCTACTCATTGTCCTCCACCC<br>TCACCCTGAGCAAGGCCGATTACG<br>AGAAGCATAAGGTCTACGCCTGCG<br>AAGTGACCCACCAGGGCCTGAGCA<br>GCCCAGTGACGAAGTCCTTCAACC<br>GGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | AGCCGAAGGACACTCTGATGATTTCA CGCACCCCGGAAGTCACTTGCGTGGT CGTGGACGTGTCGCACGAAGATCCC GAAGTGAAATTCAATTGGTACGTGG ATGGGGTCGAAGTGCACAACGCCAA GACCAAGCCTAGGGAAGAACAGTAC AACTCTACGTACCGGGTGGTGTCCGT GCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | | |
| SEQ ID 1702 | CAGGTCCAGCTGGTGCAGTCTGGGG GAGGCTTGGTAAAGCCTGGGGGGTC CCTTAGACTCTCCTGTGCAGCCTCTG GATTCACTTTCAGTAACGCCTGGATG AGCTGGGTCCGCCAGGCTCCAGGGA AGGGGCTGGAGTGGGTTGGCCGTAT TAAAAGCAAAACTGATGGTGGGACA ACAGACTACGCTGCACCCGTGAAAG GCAGATTCACCATCTCAAGAGATGAT TCAAAAAACACGCTGTATCTGCAAAT GAACAGCCTGAAAACCGAGGACACA GCCGTGTATTACTGTACCACAGACGA GTATTTCTACTGGGGCCAGGGAACCC TGGTCACCGTCTCCTCAGCATCCACC AAGGGGCCTTCCGTGTTCCCCCTGGC CCCTTCATCCAAGTCGACCTCTGGTG GAACCGCCGCACTCGGTTGCCTGGTC AAAGACTACTTCCCCGAGCCCGTGAC TGTCTCGTGGAACTCGGGCGCCCTCA CATCCGGAGTGCATACCTTTCCCGCC GTGTTGCAGTCCAGCGGCCTGTACAG CCTGAGCTCCGTCGTGACAGTGCCGT CCTCCTCCCTTGGAACCCAGACCTAT ATCTGCAACGTCAATCACAAGCCCTC CAACACCAAAGTGGACAAGAAGGTC GAACCCAAGTCCTGCGACAAGACTC ACACCTGTCCGCCTTGTCCAGCCCCT GAGCTGCTGGGTGGTCCGTCCGTGTT CCTCTTCCCGCCCAAGCCGAAGGACA CTCTGATGATTTCACGCACCCCGGAA GTCACTTGCGTGGTCGTGGACGTGTC GCACGAAGATCCCGAAGTGAAATTC AATTGGTACGTGGATGGGGTCGAAG TGCACAACGCCAAGACCAAGCCTAG GGAAGAACAGTACAACTCTACGTAC CGGGTGGTGTCCGTGCTGACCGTGCT GCACCAGGACTGGCTGAACGGAAAG GAGTACAAGTGTCAAACA AGGCTCTCCCTGCCCCTATCGAAAAG ACCATCAGCAAGGCCAAGGGTCAAC CTAGGGAGCCCCAGGTCTATACTTTG CCGCCTAGCCGGGAAGAAATGACTA AGAACCAAGTGTCCCTGACTTGCCTT GTCAAGGGCTTTTATCCGTCCGACAT CGCCGTGGAGTGGGAGTCCAACGGA CAACCGGAGAACAACTACAAGACCA CCCCACCGGTGCTCGATTCCGATGGC TCCTTCTTCCTGTACTCCAAGCTGAC TGTGGACAAGTCAAGATGGCAGCAG | SEQ ID 1810 | GAAACGACACTCACGCAGTCTCCA GGCACCCTGTCTTTGTCTCCAGGGG AAAGAGCCACCCTCTCCTGCAGGG CCAGTCAGAGTATTAGCAGCACCT ACTTAGCCTGGTACCAGCAGAAAC CTGGCCAGGCTCCCAGGCTCCTCAT CTATGGTGCATCCACCAGGGCCAC TGGCATCCCAGACAGGTTCAGTGG CAGTGGGTCTGGGACAGACTTCAC TCTCAGCATCAGCAGACTGGAGCC TGAAGATTTTGCAGTGTATTACTGT CAGCAGTATGGTAACTCACCTCCG GGAGCCACCTTCGGCCAAGGGACA CGACTGGAGATTAAACGTACTGTG GCTGCTCCCTCCGTGTTCATTTTTC CTCCGTCGGACGAACAGCTGAAGT CCGGAACCGCGTCCGTGGTCTGTCT CCTGAACAACTTCTATCCGCGCGA GGCGAAAGTGCAGTGGAAGGTCGA CAACGCACTGCAGTCGGGAAACTC CCAGGAATCGGTGACCGAGCAGGA CTCGAAGGACTCAACCTACTCATT GTCCTCCACCCTCACCCTGAGCAA GGCCGATTACGAGAAGCATAAGGT CTACGCCTGCGAAGTGACCCACCA GGGCCTGAGCAGCCCAGTGACGAA GTCCTTCAACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GGAAACGTGTTCTCCTGCTCCGTGAT GCACGAAGCGCTGCACAACCATTAC ACCCAGAAATCACTGTCACTTTCGCC GGGAAA | | |
| SEQ ID 1703 | CAGGTGCAGCTACAGCAGTGGGGCG CAGGACTGTTGAAGCCTTCGGAGAC CCTGTCCCTCACCTGCGCTGTCTATG GTGGGTCCTTCAGTGGTTACTACTGG AGCTGGATCCGCCAGCCCCCAGGGA AGGGGCTGGAGTGGATTGGGGAAAT CAATCATAGTGGAAGCACCAACTAC AACCCGTCCCTCAAGAGTCGAGTCAC CATATCAGTAGACACGTCCAAGAAC CAGTTCTCCCTGAAGCTGAGCTCTGT GACCGCCGCGGACACGGCTGTGTATT ACTGTGCGAGAGTAAATCCGGGGAG TTATACGAGGGAGGTGAGCAACTTT GACTACTGGGGCCAGGGAACCCTGG TGACCGTCTCCTCAGCATCCACCAAG GGGCCTTCCGTGTTCCCCCTGGCCCC TTCATCCAAGTCGACCTCTGGTGGAA CCGCCGCACTCGGTTGCCTGGTCAAA GACTACTTCCCCGAGCCCGTGACTGT CTCGTGGAACTCGGGCGCCCTCACAT CCGGAGTGCATACCTTTCCCGCCGTG TTGCAGTCCAGCGGCCTGTACAGCCT GAGCTCCGTCGTGACAGTGCCGTCCT CCTCCCTTGGAACCCAGACCTATATC TGCAACGTCAATCACAAGCCCTCCAA CACCAAAGTGGACAAGAAGGTCGAA CCCAAGTCCTGCGACAAGACTCACA CCTGTCCGCCTTGTCCAGCCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | SEQ ID 1811 | GACATCCAGTTGACCCAGTCTCCTT CCTCCCTGTCTGCATCTGTGGGAGA AAGAGTCACCATCACTTGCCGGTC CAGCCAGGCCCTGCGAAATGTTGT CGGCCTTGGCGATGATTTAGCCTG GTATCAACACACGCCAGGCAGCGC CCCCAAGATCCTGATCTACTCTACA TCGACTTTACAAAGTGGAGTCTCAT CAAGATTCAGCGGCGGAAAGTCTG GGAGAGACTTCACTCTCACGATCG ATCGTCTGCAGCCTGGAGATTCTGC AACTTATTACTGTCTCCAGCACCAT GATTTCCCTTTCACTTTCGGCCCTG GGACCAAGGTGGAAATCAAACGTA CTGTGGCTGCTCCCTCCGTGTTCAT TTTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1704 | CAGGTACAGCTGCAGCAGTCAGGTC CAGAATTGGTGAAGCCCTCGCAGAC CCTCACACTCACCTGTGGCATCTCCG GGGACAGTGTCTCTAGCAACAGTGTT ACTTGGAACTGGGTCAGGCAGTCCCC ATCGGAGGCCTTGAGTGGCTGGGA AGGACTTACTACCGGTCCCAGTGGTA TTATAATTATGCGGTGTCTGTGAAAA GTCGAATAACCATCAGCCCAGACAC ATCCAAGAACCAGTTCTCCCTGCAGT TGAATTCTGTGACTCCCGAGGACACG GCTGTCTATTACTGTGCAACCAGGGG ACATAACTACGGTGTAGATTACTGGG GCCCGGGGACCACGGTCACCGTCTCC TCAGCATCCACCAAGGGGCCTTCCGT | SEQ ID 1812 | GATGTTGTGATGACTCAGTCTCCAC TCTCCCTGCCCGTCACCCCTGGAGA GCCGGCCTCCATCTCCTGCAGGTCT AGTCAGAGCCTCCTGAATAGTAAT GGATACAACTATTTGGAGTGGTAC CTGCAGAAGCCGGGGCAGTCTCCA CAGCTCCTGATCTATTTGGGTTCTA ATCGGGCCTCCGGGGTCCCTGACA GGTTCAGTGGCAGTGGATCAGGCA CAGATTTTACACTGAAAATCAGCA GAGTGGAGGCTGACGATGTGGTG TTTATTACTGCATGCAGTCTCTACA AACTCCTCTCACTTTCGGCGGTGGG ACCAAGCTGGAGATCAAACGTACT GTGGCTGCTCCCTCCGTGTTCATTT |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | GTTCCCCCTGGCCCCTTCATCCAAGT<br>CGACCTCTGGTGGAACCGCCGCACTC<br>GGTTGCCTGGTCAAAGACTACTTCCC<br>CGAGCCCGTGACTGTCTCGTGGAACT<br>CGGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | TTCCTCCGTCGGACGAACAGCTGA<br>AGTCCGGAACCGCGTCCGTGGTCT<br>GTCTCCTGAACAACTTCTATCCGCG<br>CGAGGCGAAAGTGCAGTGGAAGGT<br>CGACAACGCACTGCAGTCGGGAAA<br>CTCCCAGGAATCGGTGACCGAGCA<br>GGACTCGAAGGACTCAACCTACTC<br>ATTGTCCTCCACCCTCACCCTGAGC<br>AAGGCCGATTACGAGAAGCATAAG<br>GTCTACGCCTGCGAAGTGACCCAC<br>CAGGGCCTGAGCAGCCCAGTGACG<br>AAGTCCTTCAACCGGGGAGAATGC |
| SEQ ID<br>1705 | CAGGTGCAGCTGGTGCAGTCTGGGG<br>GAGGCTTGGTAAAGCCTGGGGGGTC<br>CCTTAGACTCTCCTGTGCAGCCTCTG<br>GATTCACTTTCAGTAACGCCTGGATG<br>AGCTGGGTCCGCCAGGCTCCAGGGA<br>AGGGGCTGGAGTGGGTTTGCCGTATT<br>AAAAGCAAAACTGATGGTGAGACAA<br>CAGACTACGCTGCACCCGTGAAAGG<br>CAGATTCACCATCTCAAGAGATGATT<br>CAAAAAACACGCTGTATCTGCAAAT<br>GAACAGCCTGAAAACTGAGGACACA<br>GCCGTGTATCACTGTACCACAGGGGT<br>GGGATGGTCGCCCTTCCAATACTGGG<br>GCCAGGGCACCCTGGTCACCGTCTCC<br>TCAGCATCCACCAAGGGGCCTTCCGT<br>GTTCCCCCTGGCCCCTTCATCCAAGT<br>CGACCTCTGGTGGAACCGCCGCACTC<br>GGTTGCCTGGTCAAAGACTACTTCCC<br>CGAGCCCGTGACTGTCTCGTGGAACT<br>CGGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT | SEQ ID<br>1813 | GAAACGACACTCACGCAGTCTCCA<br>GGCACCCTGTCTTTGTCTCCAGGGG<br>AAAGAGCCACCCTCTCCTGCAGGG<br>CCAGTCAGAGTGTTAGCAGCAGCT<br>ACTTAGCCTGGTACCAGCAGAAAC<br>CTGGCCAGGCTCCCAGGCTCCTCAT<br>CTATGGTGCATCCAGCAGGGCCAC<br>TGGCATCCCAGACAGGTTCAGTGG<br>CAGTGGGTCTGGGACAGACTTCAC<br>TCTCACCATCAGCAGACTGGAGCC<br>TGAAGATTTTGCAGTGTATTACTGT<br>CAGCAGTATGGTAGCTCACCCCGG<br>ATCACCTTCGGCCAAGGGACACGA<br>CTGGAGATTAAACGTACTGTGGCT<br>GCTCCCTCCGTGTTCATTTTTCCTC<br>CGTCGGACGAACAGCTGAAGTCCG<br>GAACCGCGTCCGTGGTCTGTCTCCT<br>GAACAACTTCTATCCGCGCGAGGC<br>GAAAGTGCAGTGGAAGGTCGACAA<br>CGCACTGCAGTCGGGAAACTCCCA<br>GGAATCGGTGACCGAGCAGGACTC<br>GAAGGACTCAACCTACTCATTGTC<br>CTCCACCCTCACCCTGAGCAAGGC<br>CGATTACGAGAAGCATAAGGTCTA<br>CGCCTGCGAAGTGACCCACCAGGG<br>CCTGAGCAGCCCAGTGACGAAGTC<br>CTTCAACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | | |
| SEQ ID 1706 | GAGGTCCAGCTGGTACAGTCTGGGG GAGGCTTGGTACAGCCAGGGCGGTC CCTGAGACTCTCCTGTACAGCTTCTG GATTCACCTTTGGTGATTATGCTATG AGCTGGTTCCGCCAGGCTCCAGGGA AGGGGCTGGAGTGGGTAGGTTTCATT AGAAGCAAAGCTTATGGTGGGACAA CAGAATACGCCGCGTCTGTGAAAGG CAGATTCACCATCTCAAGAGATGATT CCAAAAGCATCGCCTATCTGCAAATG AACAGCCTGAAAACCGAGGACACAG CCGTGTATTACTGTACTAGAGACGAC AAAAATAGCAGCAGCTGGATTCACAT ACTGGTACTTCGATCTCTGGGGCCGT GGCACCCTGGTCACCGTCTCCTCAGC ATCCACCAAGGGGCCTTCCGTGTTCC CCCTGGCCCCTTCATCCAAGTCGACC TCTGGTGGAACCGCCGCACTCGGTTG CCTGGTCAAAGACTACTTCCCCGAGC CCGTGACTGTCTCGTGGAACTCGGGC GCCCTCACATCCGGAGTGCATACCTT TCCCGCCGTGTTGCAGTCCAGCGGCC TGTACAGCCTGAGCTCCGTCGTGACA GTGCCGTCCTCCTCCCTTGGAACCCA GACCTATATCTGCAACGTCAATCACA AGCCCTCCAACACCAAAGTGGACAA GAAGGTCGAACCCAAGTCCTGCGAC AAGACTCACACCTGTCCGCCTTGTCC AGCCCCTGAGCTGCTGGGTGGTCCGT CCGTGTTCCTCTTCCCGCCCAAGCCG AAGGACACTCTGATGATTTCACGCAC CCCGGAAGTCACTTGCGTGGTCGTGG ACGTGTCGCACGAAGATCCCGAAGT GAAATTCAATTGGTACGTGGATGGG GTCGAAGTGCACAACGCCAAGACCA AGCCTAGGGAAGAACAGTACAACTC TACGTACCGGGTGGTGTCCGTGCTGA CCGTGCTGCACCAGGACTGGCTGAA CGGAAAGGAGTACAAGTGCAAAGTG TCAAACAAGGCTCTCCCTGCCCCTAT CGAAAAGACCATCAGCAAGGCCAAG GGTCAACCTAGGGAGCCCCAGGTCT ATACTTTGCCGCCTAGCCGGGAAGA AATGACTAAGAACCAAGTGTCCCTG ACTTGCCTTGTCAAGGGCTTTTATCC GTCCGACATCGCCGTGGAGTGGGAG TCCAACGGACAACCGGAGAACAACT ACAAGACCACCCCACCGGTGCTCGA TTCCGATGGCTCCTTCTTCCTGTACTC CAAGCTGACTGTGGACAAGTCAAGA TGGCAGCAGGGAAACGTGTTCTCCTG CTCCGTGATGCACGAAGCGCTGCAC AACCATTACACCCAGAAATCACTGTC ACTTTCGCCGGGAAAA | SEQ ID 1814 | GATGTTGTGATGACTCAGTCTCCAG CCACCCTGTCTGTGTCTCCAGGGGA AAGAGCCACCCTCTCCTGCAGGGC CAGTCAGAGTGTTAGCAGCAACTT AGCCTGGTACCAGCAGAAACCTGG CCAGGCTCCCAGGCTCCTCATCTAT GGTGCATCCACCAGGGCCACTGGT ATCCCAGCCAGGTTCAGTGGCAGT GGGTCTGGGACAGAGTTCACTCTC ACCATCAGCAGCCTGCAGTCTGAA GATTTTGCAGTTTATTACTGTCAGC AGTATAATAACTGGCCTCCTATGTA CACTTTTGGCCAGGGGACCAAGCT GGAGATCAAACGTACTGTGGCTGC TCCCTCCGTGTTCATTTTTCCTCCGT CGGACGAACAGCTGAAGTCCGGAA CCGCGTCCGTGGTCTGTCTCCTGAA CAACTTCTATCCGCGCGAGGCGAA AGTGCAGTGGAAGGTCGACAACGC ACTGCAGTCGGGAAACTCCCAGGA ATCGGTGACCGAGCAGGACTCGAA GGACTCAACCTACTCATTGTCCTCC ACCCTCACCCTGAGCAAGGCCGAT TACGAGAAGCATAAGGTCTACGCC TGCGAAGTGACCCACCAGGGCCTG AGCAGCCCAGTGACGAAGTCCTTC AACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| SEQ ID 1707 | CAGGTGCAGCTGGTGCAGTCTGGGG CTGAGGTGAAGAAGCCTGGGGCCTC AGTGAAGGTCTCCTGCAAGGCTTCTG GATACACCTTCGCCGCCTATTATTTA CACTGGGTGCGACAGGCCCCTGGAC AAGGCCTTGAGTGGATGGGCGGAT CAGCCCTGGTAACGGTGTCACAAGTT ATGCACAGAAATTTCAGGGCAGAGT CACCATGACCGGGGACACGTCCATT AACACAGTCTACATGCAACTGAACA ATTTGATTTCTGGCGACACGGCCGTA TATTACTGTGCGAGAGAGGCTGCCG ACGACCCGTTTGACCATTGGGGCCAG GGAGCCCTGGTCACCGTCTCCTCAGC ATCCACCAAGGGGCCTTCCGTGTTCC CCCTGGCCCCTTCATCCAAGTCGACC TCTGGTGGAACCGCCGCACTCGGTTG CCTGGTCAAAGACTACTTCCCCGAGC CCGTGACTGTCTCGTGGAACTCGGGC GCCCTCACATCCGGAGTGCATACCTT TCCCGCCGTGTTGCAGTCCAGCGGCC TGTACAGCCTGAGCTCCGTCGTGACA GTGCCGTCCTCCTCCCTTGGAACCCA GACCTATATCTGCAACGTCAATCACA AGCCCTCCAACACCAAAGTGGACAA GAAGGTCGAACCCAAGTCCTGCGAC AAGACTCACACCTGTCCGCCTTGTCC AGCCCCTGAGCTGCTGGGTGGTCCGT CCGTGTTCCTCTTCCCGCCCAAGCCG AAGGACACTCTGATGATTTCACGCAC CCCGGAAGTCACTTGCGTGGTCGTGG ACGTGTCGCACGAAGATCCCGAAGT GAAATTCAATTGGTACGTGGATGGG GTCGAAGTGCACAACGCCAAGACCA AGCCTAGGGAAGAACAGTACAACTC TACGTACCGGGTGGTGTCCGTGCTGA CCGTGCTGCACCAGGACTGGCTGAA CGGAAAGGAGTACAAGTGCAAAGTG TCAAACAAGGCTCTCCCTGCCCCTAT CGAAAAGACCATCAGCAAGGCCAAG GGTCAACCTAGGGAGCCCCAGGTCT ATACTTTGCCGCCTAGCCGGGAAGA AATGACTAAGAACCAAGTGTCCCTG ACTTGCCTTGTCAAGGGCTTTTATCC GTCCGACATCGCCGTGGAGTGGGAG TCCAACGGACAACCGGAGAACAACT ACAAGACCACCCCACCGGTGCTCGA TTCCGATGGCTCCTTCTTCCTGTACTC CAAGCTGACTGTGGACAAGTCAAGA TGGCAGCAGGGAAACGTGTTCTCCTG CTCCGTGATGCACGAAGCGCTGCAC AACCATTACACCCAGAAATCACTGTC ACTTTCGCCGGGAAAA | SEQ ID 1815 | GATGTTGTGATGACTCAGTCTCCAG CCACCCTGTCTGTGTCTCCAGGGGA AAGAGTCACACTCTCCTGCAGGGC CAGTCAGAGTGTTAGAGACAACGT AGGTTGGTACAAGCAGAAACCTGG CCAACCTCCCAGGCTCGTCATCTAT GGTGCATCCACCAGGGCCACTGGT ATCCCAGCCAGGATCAGTGGCAGT GGGTCTGGGACAGAGTTCACTCTC ACCATCAGCAGCCTGCAGTCTGAA GATTTTGCAGTTTATTACTGTCAGC AGTTTAATAATTGGCCTTACACTTT TGGCCAGGGGACCAAGCTGGAGAT CAAACGTACTGTGGCTGCTCCCTCC GTGTTCATTTTTCCTCCGTCGGACG AACAGCTGAAGTCCGGAACCGCGT CCGTGGTCTGTCTCCTGAACAACTT CTATCCGCGCGAGGCGAAAGTGCA GTGGAAGGTCGACAACGCACTGCA GTCGGGAAACTCCCAGGAATCGGT GACCGAGCAGGACTCGAAGGACTC AACCTACTCATTGTCCTCCACCCTC ACCCTGAGCAAGGCCGATTACGAG AAGCATAAGGTCTACGCCTGCGAA GTGACCCACCAGGGCCTGAGCAGC CCAGTGACGAAGTCCTTCAACCGG GGAGAATGC |
| SEQ ID 1708 | GAAGTGCAGCTGGTGCAGTCTGGGG GAGGCGTGGTCCAGCCTGGGAGGTC CCTGACACTCTCCTGTGCAGCCTCTG GATTCACCTTCAGTTCCCATCTTATG CACTGGGTCCGCCAGGCTCCAGGCA AGGGGCTGGAGTGGGTGGCAGTTAT ATCATATGATGGAACTAGTAAATATT ACGGAGACTCCGTGAAGGGCCGCTT CACCATCTCCAGAGACAATTCCAAG AACACGTTGTATCTGCAAATGAACA GCCTGCGAGCTGAAGACACGGCTAT ATATTACTGTGCGAAAGCAGATTATA AATATGACTGGGGCCAGGGAACCCT GGTCACCGTCTCCTCAGCATCCACCA AGGGGCCTTCCGTGTTCCCCCTGGCC CCTTCATCCAAGTCGACCTCTGGTGG AACCGCCGCACTCGGTTGCCTGGTCA AAGACTACTTCCCCGAGCCCGTGACT GTCTCGTGGAACTCGGGCGCCCTCAC ATCCGGAGTGCATACCTTTCCCGCCG TGTTGCAGTCCAGCGGCCTGTACAGC | SEQ ID 1816 | GACATCCAGATGACCCAGTCTCCA TCCTCCCTGTCTGCATCTGTAGGAG ACAGAGTCACCATCACTTGCCGGG CAAGTCAGAGCATTAGCAGCTATT TAAATTGGTATCAGCAGAAACCAG GGAAAGCCCCTAACCTCCTGATCT ATGCTGCATCCAGTTTGCACACTGG GGTCCCATCAAGGTTCAGTGGCAG TGGATCTGGGACAGATTTCACTCTC ACCATCAGCAGTCTGCAACCTGAA GATTTTGCAACTTACTACTGTCAAC AGAGTTACAGTATTCCTCGAACGTT CGGCCAAGGGACCAAGGTGGAAAT CAAACGTACTGTGGCTGCTCCCTCC GTGTTCATTTTTCCTCCGTCGGACG AACAGCTGAAGTCCGGAACCGCGT CCGTGGTCTGTCTCCTGAACAACTT CTATCCGCGCGAGGCGAAAGTGCA GTGGAAGGTCGACAACGCACTGCA GTCGGGAAACTCCCAGGAATCGGT GACCGAGCAGGACTCGAAGGACTC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
|  | CTGAGCTCCGTCGTGACAGTGCCGTC<br>CTCCTCCCTTGGAACCCAGACCTATA<br>TCTGCAACGTCAATCACAAGCCCTCC<br>AACACCAAAGTGGACAAGAAGGTCG<br>AACCCAAGTCCTGCGACAAGACTCA<br>CACCTGTCCGCCTTGTCCAGCCCCTG<br>AGCTGCTGGGTGGTCCGTCCGTGTTC<br>CTCTTCCCGCCCAAGCCGAAGGACAC<br>TCTGATGATTTCACGCACCCCGGAAG<br>TCACTTGCGTGGTCGTGGACGTGTCG<br>CACGAAGATCCCGAAGTGAAATTCA<br>ATTGGTACGTGGATGGGGTCGAAGT<br>GCACAACGCCAAGACCAAGCCTAGG<br>GAAGAACAGTACAACTCTACGTACC<br>GGGTGGTGTCCGTGCTGACCGTGCTG<br>CACCAGGACTGGCTGAACGGAAAGG<br>AGTACAAGTGCAAAGTGTCAAACAA<br>GGCTCTCCCTGCCCCTATCGAAAAGA<br>CCATCAGCAAGGCCAAGGGTCAACC<br>TAGGGAGCCCCAGGTCTATACTTTGC<br>CGCCTAGCCGGGAAGAAATGACTAA<br>GAACCAAGTGTCCCTGACTTGCCTTG<br>TCAAGGGCTTTTATCCGTCCGACATC<br>GCCGTGGAGTGGGAGTCCAACGGAC<br>AACCGGAGAACAACTACAAGACCAC<br>CCCACCGGTGCTCGATTCCGATGGCT<br>CCTTCTTCCTGTACTCCAAGCTGACT<br>GTGGACAAGTCAAGATGGCAGCAGG<br>GAAACGTGTTCTCCTGCTCCGTGATG<br>CACGAAGCGCTGCACAACCATTACA<br>CCCAGAAATCACTGTCACTTTCGCCG<br>GGAAAA |  | AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |
| SEQ ID<br>1709 | GAGGTGCAGCTGGTGCAGTCTGGGG<br>GAGGCTTGGTCAAGCCTGGAGGGTC<br>CCTGAGACTCTCCTGTACAGCTTCTG<br>GATTCACCTTTGGTGATTATGCTATG<br>AGCTGGGTCCGCCAGGCTCCAGGGA<br>AGGGGCTGGAGTGGGTAGGTTTCATT<br>AGAAGCAAAGCTTATGGTGGGACAA<br>CAGAATACGCCGTCTGTGAAAGG<br>CAGATTCACCATCTCAAGAGATGATT<br>CCAAAAGCATCGCCTATCTGCAAATG<br>AACAGCCTGAAAACCGAGGACACAG<br>CCGTGTATTACTGTACTACTCATAGA<br>CGCCCAATTTACGATATTTTGACTGG<br>TTTTGACTACTGGGGCCAGGGAACCC<br>TGGTCACCGTCTCCTCAGCATCCACC<br>AAGGGGCCTTCCGTGTTCCCCCTGGC<br>CCCTTCATCCAAGTGACCTCTGGTG<br>GAACCGCCGCACTCGGTTGCCTGGTC<br>AAAGACTACTTCCCCGAGCCCGTGAC<br>TGTCTCGTGGAACTCGGGCGCCCTCA<br>CATCCGGAGTGCATACCTTTCCCGCC<br>GTGTTGCAGTCCAGCGGCCTGTACAG<br>CCTGAGCTCCGTCGTGACAGTGCCGT<br>CCTCCTCCCTTGGAACCCAGACCTAT<br>ATCTGCAACGTCAATCACAAGCCCTC<br>CAACACCAAAGTGGACAAGAAGGTC<br>GAACCCAAGTCCTGCGACAAGACTC<br>ACACCTGTCCGCCTTGTCCAGCCCCT<br>GAGCTGCTGGGTGGTCCGTCCGTGTT<br>CCTCTTCCCGCCCAAGCCGAAGGACA<br>CTCTGATGATTTCACGCACCCCGGAA<br>GTCACTTGCGTGGTCGTGGACGTGTC<br>GCACGAAGATCCCGAAGTGAAATTC<br>AATTGGTACGTGGATGGGGTCGAAG<br>TGCACAACGCCAAGACCAAGCCTAG<br>GGAAGAACAGTACAACTCTACGTAC<br>CGGGTGGTGTCCGTGCTGACCGTGCT<br>GCACCAGGACTGGCTGAACGGAAAG<br>GAGTACAAGTGCAAAGTGTCAAACA<br>AGGCTCTCCCTGCCCCTATCGAAAAG<br>ACCATCAGCAAGGCCAAGGGTCAAC<br>CTAGGGAGCCCCAGGTCTATACTTTG | SEQ ID<br>1817 | GATGTTGTGATGACTCAGTCTCCAG<br>CCACCCTGTCTGTGACTCCAGGGG<br>AAAGGGCCACCCTCTCCTGCAGGG<br>CCAGTCAAAGTGTTAACAGCAACG<br>TAGCCTGGTACCAGCAGAAACCTG<br>GCCAGGCTCCCAGGCTCCTCATCTA<br>TGATGTATCCACCAGGGCCACTGA<br>TATCCCAGCCAGGTTCAGTGGCAG<br>TGGGTCTGGGACAGACTTCACTCTC<br>ACCATCAGCAGACTTGACCCTGAA<br>GATTTTGCAGTGTATTACTGTCAGC<br>AGTGTGCTAGCTCACCTCCTGTCAC<br>TTTCGGCGGAGGGACCAAGCTGGA<br>GATCAAACGTACTGTGGCTGCTCC<br>CTCCGTGTTCATTTTTCCTCCGTCG<br>GACGAACAGCTGAAGTCCGGAACC<br>GCGTCCGTGGTCTGTCTCCTGAACA<br>ACTTCTATCCGCGCGAGGCGAAAG<br>TGCAGTGGAAGGTCGACAACGCAC<br>TGCAGTCGGGAAACTCCCAGGAAT<br>CGGTGACCGAGCAGGACTCGAAGG<br>ACTCAACCTACTCATTGTCCTCCAC<br>CCTCACCCTGAGCAAGGCCGATTA<br>CGAGAAGCATAAGGTCTACGCCTG<br>CGAAGTGACCCACCAGGGCCTGAG<br>CAGCCCAGTGACGAAGTCCTTCAA<br>CCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCGCCTAGCCGGGAAGAAATGACTA AGAACCAAGTGTCCCTGACTTGCCTT GTCAAGGGCTTTTATCCGTCCGACAT CGCCGTGGAGTGGGAGTCCAACGGA CAACCGGAGAACAACTACAAGACCA CCCCACCGGTGCTCGATTCCGATGGC TCCTTCTTCCTGTACTCCAAGCTGAC TGTGGACAAGTCAAGATGGCAGCAG GGAAACGTGTTCTCCTGCTCCGTGAT GCACGAAGCGCTGCACAACCATTAC ACCCAGAAATCACTGTCACTTTCGCC GGGAAAA | | |
| SEQ ID 1710 | CAGCTGCAGCTGCAGGAGTCCGGGG GAGGCTTGGTACAGCCAGGGCGGTC CCTGAGACTCTCCTGTACAGCTTCTG GATTCACCTTTGGTGATTATGCTATG AGCTGGGTCCGCCAGGCTCCAGGGA AGGGGCTGGAGTGGGTAGGTTTCATT AGAAGCAAAGCTTATGGTGGGACAA CAGAATACGCCGCGTCTGTGAAAGG CAGATTCACCATCTCAAGAGATGATT CCAAAAGCATCGCCTATCTGCAAATG AACAGCCTGAAAACCGAGGACACAG CCGTGTATTACTGTACTAGAGAGGAT ACTATGGTTCGGGGAGTTATTCCCTG GGGCCAGGGAACCCTGGTCACCGTC TCCTCAGCATCCACCAAGGGGCCTTC CGTGTTCCCCCTGGCCCCTTCATCCA AGTCGACCTCTGGTGGAACCGCCGC ACTCGGTTGCCTGGTCAAAGACTACT TCCCCGAGCCCGTGACTGTCTCGTGG AACTCGGGCGCCCTCACATCCGGAGT GCATACCTTTCCCGCCGTGTTGCAGT CCAGCGGCCTGTACAGCCTGAGCTCC GTCGTGACAGTGCCGTCCTCCTCCCT TGGAACCCAGACCTATATCTGCAACG TCAATCACAAGCCCTCCAACACCAA AGTGGACAAGAAGGTCGAACCCAAG TCCTGCGACAAGACTCACACCTGTCC GCCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTGC GTGGTCGTGGACGTGTCGCACGAAG ATCCCGAAGTGAAATTCAATTGGTAC GTGGATGGGGTCGAAGTGCACAACG CCAAGACCAAGCCTAGGGAAGAACA GTACAACTCTACGTACCGGGTGGTGT CCGTGCTGACCGTGCTGCACCAGGAC TGGCTGAACGGAAAGGAGTACAAGT GCAAAGTGTCAAACAAGGCTCTCCCT GCCCCTATCGAAAAGACCATCAGCA AGGCCAAGGGTCAACCTAGGGAGCC CCAGGTCTATACTTTGCCGCCTAGCC GGGAAGAAATGACTAAGAACCAAGT GTCCCTGACTTGCCTTGTCAAGGGCT TTTATCCGTCCGACATCGCCGTGGAG TGGGAGTCCAACGGACAACCGGAGA ACAACTACAAGACCACCCCACCGGT GCTCGATTCCGATGGCTCCTTCTTCC TGTACTCCAAGCTGACTGTGGACAAG TCAAGATGGCAGCAGGGAAACGTGT TCTCCTGCTCCGTGATGCACGAAGCG CTGCACAACCATTACACCCAGAAATC ACTGTCACTTTCGCCGGGAAAA | SEQ ID 1818 | GAAATTGTGATGACGCAGTCTCCA GCCACCCTGTCTTTGTCTCCAGGGG AAAGAGCCACCCTCTCCTGCGGG CCAGTCAGAGTGTTAGCAGCAGCT ACTTAGCCTGGTACCAGCAGAAAC CTGGCCTGGCGCCCAGGCTCCTCAT CTATGATGCATCCAGCAGGGCCAC TGGCATCCCAGACAGGTTCAGTGG CAGTGGGTCTGGGACAGACTTCAC TCTCACCATCAGCAGACTGGAGCC TGAAGATTTTGCAGTGTATTACTGT CAGCAGTATGGTAGCTCACCTCGG GTCACTTTCGGCGGAGGGACCAAA GTGGATATCAAACGTACTGTGGCT GCTCCCTCCGTGTTCATTTTTCCTC CGTCGGACGAACAGCTGAAGTCCG GAACCGCGTCCGTGGTCTGTCTCCT GAACAACTTCTATCCGCGCGAGGC GAAAGTGCAGTGGAAGGTCGACAA CGCACTGCAGTCGGGAAACTCCCA GGAATCGGTGACCGAGCAGGACTC GAAGGACTCAACCTACTCATTGTC CTCCACCCTCACCCTGAGCAAGGC CGATTACGAGAAGCATAAGGTCTA CGCCTGCGAAGTGACCCACCAGGG CCTGAGCAGCCCAGTGACGAAGTC CTTCAACCGGGGAGAATGC |
| SEQ ID 1711 | CAGCTGCAGCTGCAGGAGTCCGGCT CAGGACTGGTGAAGCCTTCACAGAC CCTGTCCCTCACCTGCGCTGTCTCTG GTGGCTCCATCAGCAGTGGTGGTTAC TCCTGGAGCTGGATCCGGCAGCCACC AGGGAAGGGCCTGGAGTGGATTGGG TACATCTATATCAGTGGGAGCACCTA CTACAACCCGTCCCTCAAGAGTCGAG | SEQ ID 1819 | GATGTTGTGATGACTCAGTCTCCAG GCACCCTGTCTTTGTCTCCAGGGGA AAGAGCCACCCTCTCCTGCAGGGC CAGTCAGAGTGTTAGCAGCAGCGC CTTAGCCTGGTTCCAGCAGAAACC TGGCCAGGCTCCCAGGCTCCTCATC TATGATTCATCCAGCAGGGCCACT GGCATCCCAGACAGCTTCAGCGGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TCACCATATCAGTAGACAGGTCCAA<br>GAACCAGTTCTCCCTGAAGCTGAGCT<br>CTGTGACCGCCGCGGACACGGCTGT<br>GTATTACTGTGCGAGAGATCGGCGTT<br>ACTATGATAGTAGTGGTTATTATCCC<br>GCCTACTACTTTGACTACTGGGGCCA<br>GGGAACCCTGGTCACCGTCTCCTCAG<br>CATCCACCAAGGGGCCTTCCGTGTTC<br>CCCCTGGCCCCTTCATCCAAGTCGAC<br>CTCTGGTGGAACCGCCGCACTCGGTT<br>GCCTGGTCAAAGACTACTTCCCCGAG<br>CCCGTGACTGTCTCGTGGAACTCGGG<br>CGCCCTCACATCCGGAGTGCATACCT<br>TTCCCGCCGTGTTGCAGTCCAGCGGC<br>CTGTACAGCCTGAGCTCCGTCGTGAC<br>AGTGCCGTCCTCCTCCCTTGGAACCC<br>AGACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGTC<br>CAGCCCCTGAGCTGCTGGGTGGTCCG<br>TCCGTGTTCCTCTTCCCGCCCAAGCC<br>GAAGGACACTCTGATGATTTCACGCA<br>CCCCGGAAGTCACTTGCGTGGTCGTG<br>GACGTGTCGCACGAAGATCCCGAAG<br>TGAAATTCAATTGGTACGTGGATGGG<br>GTCGAAGTGCACAACGCCAAGACCA<br>AGCCTAGGGAAGAACAGTACAACTC<br>TACGTACCGGGTGGTGTCCGTGCTGA<br>CCGTGCTGCACCAGGACTGGCTGAA<br>CGGAAAGGAGTACAAGTGCAAAGTG<br>TCAAACAAGGCTCTCCCTGCCCCTAT<br>CGAAAAGACCATCAGCAAGGCCAAG<br>GGTCAACCTAGGGAGCCCCAGGTCT<br>ATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | AGTGGATCTGGGACAGAATTCACA<br>CTCACAATCAGTAGCCTGCAGCCT<br>GAAGATTTTGCAACTTATTACTGTC<br>AACAGTTTAATACCTACCCCAACA<br>CTTTTGGCCAGGGGACCAAGCTGG<br>AGATCAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCAGTGACGAAGTCCTTCA<br>ACCGGGGAGAATGC |
| SEQ ID 1712 | GAAGTGCAGCTGGTGCAGTCTGGGG<br>GAGGCTGGTCAAGCCTGGGGGGGTC<br>CCTGAGACTCTCCTGTGCAGCCTCTG<br>GATTCACCTTCAGTAGCTATAGCATG<br>AACTGGGTCCGCCAGGCTCCAGGGA<br>AGGGGCTGGAGTGGGTTTCATACATT<br>AGTAGTAGTGGTAGTTACACAAACT<br>ACGCAGACTCTGTGAAGGGCCGATT<br>CACCATCTCCAGAGACAACGCCAAG<br>AACTCACTGTATCTGCAAATAAACAG<br>CCTGAGAGCCGAGGACACGGCCATT<br>TATTACTGTGCGAGAGACGGGGGCT<br>ATGATAGTAGTGGTTTTCACTTTGAC<br>TACTGGGGCCAGGGAACCCTGGTCA<br>CCGTCTCCTCAGCATCCACCAAGGGG<br>CCTTCCGTGTTCCCCCTGGCCCCTTC<br>ATCCAAGTCGACCTCTGGTGGAACCG<br>CCGCACTCGGTTGCCTGGTCAAAGAC<br>TACTTCCCCGAGCCCGTGACTGTCTC<br>GTGGAACTCGGGCGCCCTCACATCCG<br>GAGTGCATACCTTTCCCGCCGTGTTG<br>CAGTCCAGCGGCCTGTACAGCCTGA<br>GCTCCGTCGTGACAGTGCCGTCCTCC<br>TCCCTTGGAACCCAGACCTATATCTG<br>CAACGTCAATCACAAGCCCTCCAAC<br>ACCAAAGTGGACAAGAAGGTCGAAC<br>CCAAGTCCTGCGACAAGACTCACAC<br>CTGTCCGCCTTGTCCAGCCCCTGAGC | SEQ ID 1820 | GACATCCAGATGACCCAGTCTCCA<br>CTCTCCCTGCCCGTCACCCCTGGAG<br>AGCCGGCCTCCATCTCCTGCAGGTC<br>TAGTCAGAGCCTCCTGCATAGTAA<br>TGGATACAACTATTTGGATTGGTTC<br>CTGCAGAAGCCAGGGCAGTCTCCA<br>CGGCTCCTGATCTATATGGGTTCTA<br>GTCGGGCCTCCGGGGTCCCTGAGA<br>GGTTCAGTGGCAGTGGATCAGGCA<br>CAGATTTTACACTGAAAATCAGCA<br>GAGTGGAGGCTGAGGATGTTGGGG<br>TCTATTACTGCATGCAAACTTTACA<br>CACTGTCACTTTCGGCGGCGGGAC<br>CAAGGTGGAAATCAAACGTACTGT<br>GGCTGCTCCCTCCGTGTTCATTTTT<br>CCTCCGTCGGACGAACAGCTGAAG<br>TCCGGAACCGCGTCCGTGGTCTGTC<br>TCCTGAACAACTTCTATCCGCGCGA<br>GGCGAAAGTGCAGTGGAAGGTCGA<br>CAACGCACTGCAGTCGGGAAACTC<br>CCAGGAATCGGTGACCGAGCAGGA<br>CTCGAAGGACTCAACCTACTCATT<br>GTCCTCCACCCTGAGCAAGGCCGATTACGAGAAGCATAAGGT<br>CTACGCCTGCGAAGTGACCCACCA<br>GGGCCTGAGCAGCCAGTGACGAA<br>GTCCTTCAACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TGCTGGGTGGTCCGTCCGTGTTCCTC<br>TTCCCGCCCAAGCCGAAGGACACTCT<br>GATGATTTCACGCACCCCGGAAGTCA<br>CTTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC<br>CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA<br>ACGTGTTCTCCTGCTCCGTGATGCAC<br>GAAGCGCTGCACAACCATTACACCC<br>AGAAATCACTGTCACTTTCGCCGGGA<br>AAA | | |
| SEQ ID<br>1713 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTAACAACAGGGC<br>TGCTTGGAACTGGATCAGGCAGTCGC<br>CATCGAGAGGCCTTGAGTGGCTGGG<br>AAGGACATACTACAGGTCCAAGTGG<br>TATAATGAATATGCAGTCTCTGTGAA<br>AAGTCGAATAACCATCAACCCAGAC<br>ACATCCAAGAACCAGTTCTCCCTGCA<br>GCTGAACTCTATGACTCCCGAGGACT<br>CGGCTGTGTATTACTGTGCAATTTTG<br>CCTAGTAGTGGTTATCTACAGGACCA<br>CCACTACTACGGTATGGACGTCTGGG<br>GCCAAGGGACCACGGTCACCGTCTC<br>CTCAGCATCCACCAAGGGGCCTTCCG<br>TGTTCCCCCTGGCCCCTTCATCCAAG<br>TCGACCTCTGGTGGAACCGCCGCACT<br>CGGTTGCCTGGTCAAAGACTACTTCC<br>CCGAGCCCGTGACTGTCTCGTGGAAC<br>TCGGGCGCCCTCACATCCGGAGTGCA<br>TACCTTTCCCGCCGTGTTGCAGTCCA<br>GCGGCCTGTACAGCCTGAGCTCCGTC<br>GTGACAGTGCCGTCCTCCTCCCTTGG<br>AACCCAGACCTATATCTGCAACGTCA<br>ATCACAAGCCCTCCAACACCAAAGT<br>GGACAAGAAGGTCGAACCCAAGTCC<br>TGCGACAAGACTCACACCTGTCCGCC<br>TTGTCCAGCCCCTGAGCTGCTGGGTG<br>GTCCGTCCGTGTTCCTCTTCCCGCCC<br>AAGCCGAAGGACACTCTGATGATTTC<br>ACGCACCCCGGAAGTCACTTGCGTG<br>GTCGTGGACGTGTCGCACGAAGATC<br>CCGAAGTGAAATTCAATTGGTACGTG<br>GATGGGGTCGAAGTGCACAACGCCA<br>AGACCAAGCCTAGGGAAGAACAGTA<br>CAACTCTACGTACCGGGTGGTGTCCG<br>TGCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC | SEQ ID<br>1821 | GAAACGACACTCACGCAGTCTCCA<br>GGCACCCTGTCTTTGTCTCCAGGGG<br>AAAGAGCCACCCTCTCCTGCAGGG<br>CCAGTCAGAGTGTTAGCAGCAGCT<br>ACTTAGCTGGTACCAGCAGAAAC<br>CTGGCCAGGCTCCCAGGCTCCTCAT<br>CTATGGTGCATCCAGCAGGGCCAC<br>TGGCATCCCAGACAGGTTCAGTGG<br>CAGTGGGTCTGGGACAGACTTCAC<br>TCTCACCATCAGCAGACTGGAGCC<br>TGAAGATTTTGCAGTGTATTACTGT<br>CAGCAGTATGGTAGCTCACTCCTCT<br>TCGGCCAAGGGACACGACTGGAGA<br>TTAAACGTACTGTGGCTGCTCCCTC<br>CGTGTTCATTTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | |
| SEQ ID 1714 | GAGGTGCAGCTGGTGCAGTCTGGAG<br>CTGAGGTGAAGAAGCCTGGGGCCTC<br>AGTGAAGGTCTCCTGCAAGGCTTCTG<br>GTTACACCTTTACCAGCTACGGTATC<br>AGCTGGGTGCGACAGGCCCCTGGAC<br>AAGGGCTTGAGTGGATGGGATGGAT<br>CAGCGCTTACAATGGTAACACAAAC<br>TATGCACAGAAGCTCCAGGGCAGAG<br>TCACCATGACCACAGACACATCCAC<br>GAGCACAGCCTACATGGAGCTGAGC<br>AGCCTGAGATCTGAGGACACGGCCG<br>TGTATTACTGTGCGAGAGCCGCGGTG<br>GGGGATGGATACAGCTATGGTCGGC<br>TCGATTGGGGCCAGGGAACCCTGGT<br>CACCGTCTCCTCAGCATCCACCAAGG<br>GGCCTTCCGTGTTCCCCCTGGCCCCT<br>TCATCCAAGTCGACCTCTGGTGGAAC<br>CGCCGCACTCGGTTGCCTGGTCAAAG<br>ACTACTTCCCCGAGCCCGTGACTGTC<br>TCGTGGAACTCGGGCGCCCTCACATC<br>CGGAGTGCATACCTTTCCCGCCGTGT<br>TGCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | SEQ ID 1822 | GACATCCAGTTGACCCAGTCTCCAT<br>CCTTCCTGTCTGCATCTGTTGGAGA<br>CAGAGTCACCATCACTTGCCGGGC<br>CAGTCAGGGCATTAGCAGTTCTTTG<br>GCCTGGTATCAGCAAAAGCCAGGG<br>AAAGCCCCTAAGCTCCTGATCTAT<br>GCTGCATCCACTTTGCAAAGTGGG<br>GTCCCATCAAGGTTCAGTGGAAGT<br>GGATCTGGGACAGATTTTACTTTCA<br>CCATCAGCAGCCTGCAGCCTGAAG<br>ATATTGCAACATATTACTGTCAACA<br>GTATGATAATCTCCCTCCTCTCACT<br>TTCGGCGGAGGGACCAAGGTGGAA<br>ATCAAACGTACTGTGGCTGCTCCCT<br>CCGTGTTCATTTTTCCTCCGTCGGA<br>CGAACAGCTGAAGTCCGGAACCGC<br>GTCCGTGGTCTGTCTCCTGAACAAC<br>TTCTATCCGCGCGAGGCGAAAGTG<br>CAGTGGAAGGTCGACAACGCACTG<br>CAGTCGGGAAACTCCCAGGAATCG<br>GTGACCGAGCAGGACTCGAAGGAC<br>TCAACCTACTCATTGTCCTCCACCC<br>TCACCCTGAGCAAGGCCGATTACG<br>AGAAGCATAAGGTCTACGCCTGCG<br>AAGTGACCCACCAGGGCCTGAGCA<br>GCCCAGTGACGAAGTCCTTCAACC<br>GGGGAGAATGC |
| SEQ ID 1715 | GAGGTCCAGCTGGTACAGTCTGGAG<br>CAGAGGTGAAAAAGCCCGGGGAGTC<br>TCTGAAGATCTCCTGTAAGGGTTCTG<br>GATACAGCTTTACCAGCTACATAGTAAT<br>GGCTGGGTGCGCCAGATGCCCGGGA<br>AAGGCCTGGAGTGGATGGGGATCAT<br>CTATCCTGGTGACTCTGATACCAGAT<br>ACAGCCCGTCCTTCCAAGGCCAGGTC<br>ACCATCTCAGCCGACAAGTCCATCAG<br>CACCGCCTACCTGCAGTGGAGCAGC<br>CTGAAGGCCTCGGACACCGCCATGT<br>ATTACTGTGCGAGACTCCCCTCGTAT<br>TACTATGATAGTAGTGGTTACTTTAC | SEQ ID 1823 | GATGTTGTGATGACTCAGTCTCCAC<br>TCTCCCTGCCCGTCACCCCTGGAGA<br>GCCGGCCTCCATCTCCTGCAGGTCT<br>AGTCAGAGCCTCCTGCATAGTAAT<br>GGATACAACTATTTGGATTGGTAC<br>CTGCAGAAGCCAGGGCAGTCTCCA<br>CAGCTCCTGATCTATTTGGGTTCTA<br>ATCGGGCCTCCGGGGTCCCTGACA<br>GGTTCAGTGGCAGTGGATCAGGCA<br>CAGATTTCACAGTGAAAATCAGCA<br>GAGTGGAGGCTGAGGATGTTGGGG<br>TTTATTACTGCATGCAAGCTCTACA<br>AACTCCGTACACTTTTGGCCAGGG |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CTGGTACTTCGATCTCTGGGGCCGTG GCACCCTGGTGACCGTCTCTTCAGCA TCCACCAAGGGGCCTTCCGTGTTCCC CCTGGCCCCTTCATCCAAGTCGACCT CTGGTGGAACCGCCGCACTCGGTTGC CTGGTCAAAGACTACTTCCCCGAGCC CGTGACTGTCTCGTGGAACTCGGGCG CCCTCACATCCGGAGTGCATACCTTT CCCGCCGTGTTGCAGTCCAGCGGCCT GTACAGCCTGAGCTCCGTCGTGACAG TGCCGTCCTCCTCCCTTGGAACCCAG ACCTATATCTGCAACGTCAATCACAA GCCCTCCAACACCAAAGTGGACAAG AAGGTCGAACCCAAGTCCTGCGACA AGACTCACACCTGTCCGCCTTGTCCA GCCCCTGAGCTGCTGGGTGGTCCGTC CGTGTTCCTCTTCCCGCCCAAGCCGA AGGACACTCTGATGATTTCACGCACC CCGGAAGTCACTTGCGTGGTCGTGGA CGTGTCGCACGAAGATCCCGAAGTG AAATTCAATTGGTACGTGGATGGGGT CGAAGTGCACAACGCCAAGACCAAG CCTAGGGAAGAACAGTACAACTCTA CGTACCGGGTGGTGTCCGTGCTGACC GTGCTGCACCAGGACTGGCTGAACG GAAAGGAGTACAAGTGCAAAGTGTC AAACAAGGCTCTCCCTGCCCCTATCG AAAAGACCATCAGCAAGGCCAAGGG TCAACCTAGGGAGCCCCAGGTCTATA CTTTGCCGCCTAGCCGGGAAGAAAT GACTAAGAACCAAGTGTCCCTGACTT GCCTTGTCAAGGGCTTTTATCCGTCC GACATCGCCGTGGAGTGGGAGTCCA ACGGACAACCGGAGAACAACTACAA GACCACCCCACCGGTGCTCGATTCCG ATGGCTCCTTCTTCCTGTACTCCAAG CTGACTGTGGACAAGTCAAGATGGC AGCAGGGAAACGTGTTCTCCTGCTCC GTGATGCACGAAGCGCTGCACAACC ATTACACCCAGAAATCACTGTCACTT TCGCCGGGAAAA | | GACCAAGCTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1716 | GAGGTCCAGCTGGTACAGTCTGGAG CTGAGGTGAAGAAGCCTGGGGCCTC AGTGAAGGTCTCCTGCAAGGCTTCTG GTTACACCTTTACCAGCTATGGTATC AGCTGGGTGCGACAGGCCCCTGGAC AAGGGCTTGAGTGGATGGGATGGAT CATCCCTATCTTTGGTATAGCAAACT ACGCACAGAAGTTCCAGGGCAGAGT CACGATTACCGCGGACAAATCCACG AGCACAGCCTACATGGAGCTGAGCA GCCTGAGATCTGAGGACACGGCCGT GTATTACTGTGCGAGAGAACTATACA ACTATGGTTCAAAGGACTACTTTGAC TACTGGGGCCAGGGAACCCTGGTCA CCGTCTCCTCAGCATCCACCAAGGGG CCTTCGTGTTCCCCCTGGCCCCTTC ATCCAAGTCGACCTCTGGTGGAACCG CCGCACTCGGTTGCCTGGTCAAAGAC TACTTCCCCGAGCCCGTGACTGTCTC GTGGAACTCGGGCGCCCTCACATCCG GAGTGCATACCTTTCCCGCCGTGTTG CAGTCCAGCGGCCTGTACAGCCTGA GCTCCGTCGTGACAGTGCCGTCCTCC TCCCTTGGAACCCAGACCTATATCTG CAACGTCAATCACAAGCCCTCCAAC ACCAAAGTGGACAAGAAGGTCGAAC CCAAGTCCTGCGACAAGACTCACAC CTGTCCGCCTTGTCCAGCCCCTGAGC TGCTGGGTGGTCCGTCCGTGTTCCTC TTCCCGCCCAAGCCGAAGGACACTCT GATGATTTCACGCACCCCGGAAGTCA CTTGCGTGGTCGTGGACGTGTCGCAC GAAGATCCCGAAGTGAAATTCAATT | SEQ ID 1824 | GAAATTGTGTTGACGCAGTCTCCA CTCTCCCTGCCCGTCACCCTTGGAC AGCCGGCCTCCATCTCCTGCAGGTC TTGTCAAAGCCTCGTATACAGTGAT GGCAACACCTACTTGAATTGCTTTC AGCAGAGGCCAGGCCAATCTCCAA GGCGCCTAATTTATAAGGTTTCTAA CCGGGACTCTGGGGTCCCAGACAG ATTCAGCGGCAGTGGGTCAGGCAC AGATTTTACACTGGAAATCAGCAG AGTGGAGGCTGAGGATGTTGGGAT TTATTTCTGCATGCAAGGTCTACAA ACTCCATTCACTTTCGGCCCTGGGA CCAAAGTGGATATCAAACGTACTG TGGCTGCTCCCTCCGTGTTCATTTT TCCTCCGTCGGACGAACAGCTGAA GTCCGGAACCGCGTCCGTGGTCTG TCTCCTGAACAACTTCTATCCGCGC GAGGCGAAAGTGCAGTGGAAGGTC GACAACGCACTGCAGTCGGGGAAA TCCCAGGAATCGGTGACCGAGCAG GACTCGAAGGACTCAACCTACTCA TTGTCCTCCACCCTCACCCTGAGCA AGGCCGATTACGAGAAGCATAAGG TCTACGCCTGCGAAGTGACCCACC AGGGCCTGAGCAGCCCAGTGACGA AGTCCTTCAACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC<br>CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA<br>ACGTGTTCTCCTGCTCCGTGATGCAC<br>GAAGCGCTGCACAACCATTACACCC<br>AGAAATCACTGTCACTTTCGCCGGGA<br>AAA | | |
| SEQ ID 1717 | GAAGTGCAGCTGGTGCAGTCTGGAG<br>CAGAGGTGAAAAAGCCCGGGGAGTC<br>TCTGAAGATCTCCTGTAAGGGTTCTG<br>GATACAGCTTTACCAGCTACTGGATC<br>GGCTGGGTGCGCCAGATGCCCGGGA<br>AAGGCCTGGAGTGGATGGGGATCAT<br>CTATCCTGGTGACTCTGATACCAGAT<br>ACAGCCCGTCCTTCCAAGGCCAGGTC<br>ACCATCTCAGCCGACAAGTCCATCAG<br>CACCGCCTACCTGCAGTGGAGCAGC<br>CTGAAGGCCTCGGACACCGCCATGT<br>ATTACTGTGCGAGGGGCGGTACTTGG<br>GATACAGCTATGGTTACGGGCTTTGA<br>CTACTGGGGCCAGGGAACCCTGGTC<br>ACCGTCTCCTCAGCATCCACCAAGGG<br>GCCTTCCGTGTTCCCCCTGGCCCCTT<br>CATCCAAGTCGACCTCTGGTGGAACC<br>GCCGCACTCGGTTGCCTGGTCAAAGA<br>CTACTTCCCCGAGCCCGTGACTGTCT<br>CGTGGAACTCGGGCGCCCTCACATCC<br>GGAGTGCATACCTTTCCCGCCGTGTT<br>GCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA | SEQ ID 1825 | GATGTTGTGATGACTCAGTCTCCAG<br>GCACCCTGTCTTTGTCTCCAGGGGA<br>AAGAGCCACCCTCTCCTGCAGGGC<br>CAGTCAGAGTGTTAGCAGCAGCTA<br>CTTAGCCTGGTACCAGCAGAAACC<br>TGGCCAGGCTCCCAGGCTCCTCATC<br>TATGGTGCATCCAGCAGGGCCACT<br>GGCATCCCAGACAGGTTCAGTGGC<br>AGTGGGTCTGGGACAGACTTCACT<br>CTCACCATCAGCAGACTGGAGCCT<br>GAAGATTTTGCAGTGTATTACTGTC<br>AGCAGTATGGTAGCTCACCTGCGC<br>TCACTTTCGGCGGAGGGACCAAGC<br>TGGAGATCAAACGTACTGTGGCTG<br>CTCCCTCCGTGTTCATTTTTCCTCC<br>GTCGGACGAACAGCTGAAGTCCGG<br>AACCGCGTCCGTGGTCTGTCTCCTG<br>AACAACTTCTATCCGCGCGAGGCG<br>AAAGTGCAGTGGAAGGTCGACAAC<br>GCACTGCAGTCGGGAAACTCCCAG<br>GAATCGGTGACCGAGCAGGACTCG<br>AAGGACTCAACCTACTCATTGTCCT<br>CCACCCTCACCCTGAGCAAGGCCG<br>ATTACGAGAAGCATAAGGTCTACG<br>CCTGCGAAGTGACCCACCAGGGCC<br>TGAGCAGCCCAGTGACGAAGTCCT<br>TCAACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CGAAGCGCTGCACAACCATTACACC CAGAAATCACTGTCACTTTCGCCGGG AAAA | | |
| SEQ ID 1718 | GAAGTGCAGCTGGTGCAGTCTGGAG CAGAGGTGAAAAAGCCCGGGGAGTC TCTGAAGATCTCCTGTAAGGGTTCTG GATACAGCTTTACCAGCTACTGGATC GCCTGGGTGCGCCAGATGCCCGGGA AAGGCCTGGAGTGGATGGGGGTCAT CTATCCTGGTGACTCTGATACCAGAT ACAGCCCGTCCTTCCAAGGCCAGGTC ACCATCTCAGCCGACAAGTCCATCAA TACCGCCTACCTGCAGTGGAGCAGCC TGAAGGCCTCGGACACCGCCATGTAT TACTGTGCGAGACCCCATTACGATAT TTTGACTGGTTCCCGGGCGCCCTTTG ACTACTGGGGCCAGGGAACCCTGGT CACCGTCTCCTCAGCATCCACCAAGG GGCCTTCCGTGTTCCCCCTGGCCCCT TCATCCAAGTCGACCTCTGGTGGAAC CGCCGCACTCGGTTGCCTGGTCAAAG ACTACTTCCCCGAGCCCGTGACTGTC TCGTGGAACTCGGGCGCCCTCACATC CGGAGTGCATACCTTTCCCGCCGTGT TGCAGTCCAGCGGCCTGTACAGCCTG AGCTCCGTCGTGACAGTGCCGTCCTC CTCCCTTGGAACCCAGACCTATATCT GCAACGTCAATCACAAGCCCTCCAA CACCAAAGTGGACAAGAAGGTCGAA CCCAAGTCCTGCGACAAGACTCACA CCTGTCCGCCTTGTCCAGCCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | SEQ ID 1826 | GAAATTGTGATGACGCAGTCTCCA CTCTCCCTGCCCGTCACCCCTGGAG AGCCGGCCTCCATCTCCTGCAGGTC TAGTCAGAGCCTCCTGCATAGTAA TGGATACAACTATTTGGATTGGTAC CTGCAGAAGCCAGGGCAGTCTCCA CAGCTCCTGATCTATTTGGGTTCTA CTCGGGCCTCCGGGGTCCCTGACA GGTTCAGTGGCAGTGGATCAGGCA CAGACTTTACACTGAAAATCAGCA GAGCGGAGGCTGAGGATGTTGGGG TTTATTACTGCATGCAAGCTCTACA CACTCCGTGGACGTTCGGCCTAGG GACCAAAGTGGATATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1719 | CAGGTGCAGCTACAGCAGTGGGGCG CAGGACTGTTGAAGCCTTCGGAGAC CCTGTCCCTCACCTGCGCTGTCTATG GTGGGTCCTTCAGTGGTTACTACTGG AGCTGGATCCGCCAGCCCCCAGGGA AGGGGCTGGAGTGGATTGGGGAAAT CAATCATAGTGGAAGCACCAACTAC AACCCGTCCCTCAAGAGTCGAGTCAC CATATCAGTAGACACGTCCAAGAAC CAGTTCTCCCTGAAGCTGAGCTCTGT GACCGCCGCGGACACGGCTGTGTATT ACTGTGCGAGAGCCCGAGTGGAATC CAAGGATGGGTACTTTGACTACTGGG GCCAGGGAACCCTGGTCACCGTCTCC TCAGCATCCACCAAGGGGCCTTCCGT GTTCCCCCTGGCCCCTTCATCCAAGT | SEQ ID 1827 | GACATCCAGATGACCCAGTCTCCA GCCACCCTGTCTGTGTCTCCAGGGG AAAAGGGCCACCCTCTTTTGCCGG CCAGTGAAGGTCTTACCACCAACT TAGCCTGGTACCAGCACAAACCTG GCCAGGCTCCCAGGCTCCTCATCTA TGCTGCCTCCACCAGGGCCACTGG TGTCCCAGCCAGGTTCAGTGGCAG TGGGTCTGGGACAGACTTCACTCTC ACCATCAGCAGCCTGCAGTCTGAA GATTCCGCAGTTTATTACTGTCAGC AGTATAATCACTGGCCTCTCTACAC TTTTGGCCAGGGGACCAAGGTGGA AATCAAACGTACTGTGGCTGCTCC CTCCGTGTTCATTTTTCCTCCGTCG GACGAACAGCTGAAGTCCGGAACC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CGACCTCTGGTGGAACCGCCGCACTC<br>GGTTGCCTGGTCAAAGACTACTTCCC<br>CGAGCCCGTGACTGTCTCGTGGAACT<br>CGGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | GCGTCCGTGGTCTGTCTCCTGAACA<br>ACTTCTATCCGCGCGAGGCGAAAG<br>TGCAGTGGAAGGTCGACAACGCAC<br>TGCAGTCGGGAAACTCCCAGGAAT<br>CGGTGACCGAGCAGGACTCGAAGG<br>ACTCAACCTACTCATTGTCCTCCAC<br>CCTCACCCTGAGCAAGGCCGATTA<br>CGAGAAGCATAAGGTCTACGCCTG<br>CGAAGTGACCCACCAGGGCCTGAG<br>CAGCCCAGTGACGAAGTCCTTCAA<br>CCGGGGAGAATGC |
| SEQ ID 1720 | GAGGTGCAGCTGGTGGAGTCTGGGG<br>GAGGCGTGGTCCAGCCTGGGAGGTC<br>CCTGAGACTCTCCTGTGCAGCCTCTG<br>GATTCACTTTCACTGATGCCTGGATG<br>AACTGGGTCCGCCAGGCTCCAGGGA<br>AGGGGCTGGAGTGGATTGGCCGTGT<br>TAAAAACAAAGCTGATGGTGAGACA<br>ACGGACTACGCTGCACCCGTCAAAG<br>GCAGAATCACCATCTCAAGAGATGA<br>TGCAAAGAACACTCTGTATGTGCAA<br>ATGAACAGCCTGAAAACCGAGGACA<br>CAGCCGTGTATTATTGTACCGCTGAC<br>CTGCGACTTTCTACGTGGGATGCTTA<br>TGATTTCTGGGGCCAAGGGACAATG<br>GTCACCGTCTCTTCAGCATCCACCAA<br>GGGGCCTTCCGTGTTCCCCCTGGCCC<br>CTTCATCCAAGTCGACCTCTGGTGGA<br>ACCGCCGCACTCGGTTGCCTGGTCAA<br>AGACTACTTCCCCGAGCCCGTGACTG<br>TCTCGTGGAACTCGGGCGCCCTCACA<br>TCCGGAGTGCATACCTTTCCCGCCGT<br>GTTGCAGTCCAGCGGCCTGTACAGCC<br>TGAGCTCCGTCGTGACAGTGCCGTCC<br>TCCTCCCTTGGAACCCAGACCTATAT<br>CTGCAACGTCAATCACAAGCCCTCCA<br>ACACCAAAGTGGACAAGAAGGTCGA<br>ACCCAAGTCCTGCGACAAGACTCAC<br>ACCTGTCCGCCTTGTCCAGCCCCTGA<br>GCTGCTGGGTGGTCCGTCCGTGTTCC<br>TCTTCCCGCCCAAGCCGAAGGACACT<br>CTGATGATTTCACGCACCCCGGAAGT<br>CACTTGCGTGGTCGTGGACGTGTCGC<br>ACGAAGATCCCGAAGTGAAATTCAA<br>TTGGTACGTGGATGGGGTCGAAGTG<br>CACAACGCCAAGACCAAGCCTAGGG<br>AAGAACAGTACAACTCTACGTACCG<br>GGTGGTGTCCGTGCTGACCGTGCTGC | SEQ ID 1828 | GACATCCAGTTGACCCAGTCTCCTT<br>CCACCCTGTCTTTGTCTCCAGGGGA<br>AAGAGCCACCCTCTCCTGCAGGGCA<br>CAGTCAGAGTGTTAGCAGCTACTT<br>AGCCTGGTACCAACAGAAATCTGG<br>CCAGGCTCCCAGGCTCCTCATCTAT<br>GATGCATCCAACAGGGCCACTGGC<br>ATCCCAGCCAGGTTCAGTGGCAGT<br>GGGTCTGGGACAGACTTCACTCTC<br>ACCATCAGCAGCCTAGAGCCTGAA<br>GATTTTGCAGTTTATTACTGTCAGC<br>AGGGTAGCAACTGGCCGCTCACTT<br>TCGGCGGAGGGACCAAGGTGGAAA<br>TCAAACGTACTGTGGCTGCTCCCTC<br>CGTGTTCATTTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | ACCAGGACTGGCTGAACGGAAAGGA GTACAAGTGCAAAGTGTCAAACAAG GCTCTCCCTGCCCCTATCGAAAAGAC CATCAGCAAGGCCAAGGGTCAACCT AGGGAGCCCCAGGTCTATACTTTGCC GCCTAGCCGGGAAGAAATGACTAAG AACCAAGTGTCCCTGACTTGCCTTGT CAAGGGCTTTTATCCGTCCGACATCG CCGTGGAGTGGGAGTCCAACGGACA ACCGGAGAACAACTACAAGACCACC CCACCGGTGCTCGATTCCGATGGCTC CTTCTTCCTGTACTCCAAGCTGACTG TGGACAAGTCAAGATGGCAGCAGGG AAACGTGTTCTCCTGCTCCGTGATGC ACGAAGCGCTGCACAACCATTACAC CCAGAAATCACTGTCACTTTCGCCGG GAAAA | | |
| SEQ ID 1721 | CAGATCACCTTGAAGGAGTCTGGGG GAGGCTTGGTCCAGCCTGGGGGGTC CCTAAGACTCTCTTGTACAGTCTCAG GATTCACCTTTAGTAACAATTGGATG ACCTGGGTCCGCCAGACTCCAGGGA AGGGGCTGGAGTGGGTGGCCAACAT AAAGCAAGATGGAACTGAGAAACAC TATGTGGACTCTGTGAAGGGCCGATT CACCATCTCCAGAGACAACGCCGAG AACTCACTGTATCTGCAGATGAACAG CCTGAGAGGTGAGGACACGGCCGTG TATTATTGTGCGAGAAACAGTCAACG TTCGTTTGACTACTGGGGCCAGGGCA CCCTGGTGACCGTCTCCTCAGCATCC ACCAAGGGGCCTTCCGTGTTCCCCCT GGCCCCCTTCATCCAAGTCGACCTCTG GTGGAACCGCCGCACTCGGTTGCCTC GTCAAAGACTACTTCCCCGAGCCCGT GACTGTCTCGTGGAACTCGGGCGCCC TCACATCCGGAGTGCATACCTTTCCC GCCGTGTTGCAGTCCAGCGGCCTGTA CAGCCTGAGCTCCGTCGTGACAGTGC CGTCCTCCTCCCTTGGAACCCAGACC TATATCTGCAACGTCAATCACAAGCC CTCCAACACCAAAGTGGACAAGAAG GTCGAACCCAAGTCCTGCGACAAGA CTCACACCTGTCCGCCTTGTCCAGCC CCTGAGCTGCTGGGTGGTCCGTCCGT GTTCCTCTTCCCGCCCAAGCCGAAGG ACACTCTGATGATTTCACGCACCCCG GAAGTCACTTGCGTGGTCGTGGACGT GTCGCACGAAGATCCCGAAGTGAAA TTCAATTGGTACGTGGATGGGGTCGA AGTGCACAACGCCAAGACCAAGCCT AGGGAAGAACAGTACAACTCTACGT ACCGGGTGGTGTCCGTGCTGACCGTG CTGCACCAGGACTGGCTGAACGGAA AGGAGTACAAGTGCAAAGTGTCAAA CAAGGCTCTCCCTGCCCCTATCGAAA AGACCATCAGCAAGGCCAAGGGTCA ACCTAGGGAGCCCCAGGTCTATACTT TGCCGCCTAGCCGGGAAGAAATGAC TAAGAACCAAGTGTCCCTGACTTGCC TTGTCAAGGGCTTTTATCCGTCCGAC ATCGCCGTGGAGTGGGAGTCCAACG GACAACCGGAGAACAACTACAAGAC CACCCCACCGGTGCTCGATTCCGATG GCTCCTTCTTCCTGTACTCCAAGCTG ACTGTGGACAAGTCAAGATGGCAGC AGGGAAACGTGTTCTCCTGCTCCGTG ATGCACGAAGCGCTGCACAACCATT ACACCCAGAAATCACTGTCACTTTCG CCGGGAAAA | SEQ ID 1829 | GATATTGTGATGACCCACACTCCA CTCTCCTCACCTGTCACCCTTGGAC AGCCGGCCTCCATCTCCTGCAGGTC TAGTCAAAGCCTCGAACACACTGA TGGAAACACCTACTTAAGTTGGCTT CACCAGAGGCCAGGCCAGCCCCCA AGACTGTTAATTTATAAGGTTTCTA CCCGGTTCTCTGGGGTCCCAGACA GATTCAGTGGCAGTGGGGCAGGGA CAGATTTCACACTGAAAATCAGCA GGGTGGAGGCTGAGGATGTCGGCG TTTATTACTGCGTGCAGGCTACACA CTATCCTCGGACGTTCGGCCATGG GACCAAGGTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| SEQ ID 1722 | CAGGTCACCTTGAAGGAGTCTGGGG GAGGCGTGGTCCAGCCTGGGAGGTC CCTGAGACTCTCCTGTGCAGCCTCTG GATTCACCTTCAGTAGCTATGGCATG CACTGGGTCCGCCAGGCTCCAGGCA AGGGGCTGGAGTGGGTGGCAGTTAT ATCATATGATGGAAGTAATAAATACT ATGCAGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCGAAAGATTTAGGGG ATCCCCGGGGTGGTATTTTGAACTAC TGGGGCCAGGGCACCCTGGTCACCG TCTCCTCAGCATCCACCAAGGGGCCT TCCGTGTTCCCCCTGGCCCCTTCATC CAAGTCGACCTCTGGTGGAACCGCC GCACTGGTTGCCTGGTCAAAGACTA CTTCCCCGAGCCCGTGACTGTCTCGT GGAACTCGGGCGCCCTCACATCCGG AGTGCATACCTTTCCCGCCGTGTTGC AGTCCAGCGGCCTGTACAGCCTGAG CTCCGTCGTGACAGTGCCGTCCTCCT CCCTTGGAACCCAGACCTATATCTGC AACGTCAATCACAAGCCCTCCAACA CCAAAGTGGACAAGAAGGTCGAACC CAAGTCCTGCGACAAGACTCACACCT GTCCGCCTTGTCCAGCCCCTGAGCTG CTGGGTGGTCCGTCCGTGTTCCTCTT CCCGCCCAAGCCGAAGGACACTCTG ATGATTTCACGCACCCCGGAAGTCAC TTGCGTGGTCGTGGACGTGTCGCACG AAGATCCCGAAGTGAAATTCAATTG GTACGTGGATGGGGTCGAAGTGCAC AACGCCAAGACCAAGCCTAGGGAAG AACAGTACAACTCTACGTACCGGGT GGTGTCCGTGCTGACCGTGCTGCACC AGGACTGGCTGAACGGAAAGGAGTA CAAGTGCAAAGTGTCAAACAAGGCT CTCCCTGCCCCTATCGAAAAGACCAT CAGCAAGGCCAAGGGTCAACCTAGG GAGCCCCAGGTCTATACTTTGCCGCC TAGCCGGGAAGAAATGACTAAGAAC CAAGTGTCCCTGACTTGCCTTGTCAA GGGCTTTTATCCGTCCGACATCGCCG TGGAGTGGGAGTCCAACGGACAACC GGAGAACAACTACAAGACCACCCCA CCGGTGCTCGATTCCGATGGCTCCTT CTTCCTGTACTCCAAGCTGACTGTGG ACAAGTCAAGATGGCAGCAGGGAAA CGTGTTCTCCTGCTCCGTGATGCACG AAGCGCTGCACAACCATTACACCCA GAAATCACTGTCACTTTCGCCGGGAA AA | SEQ ID 1830 | GAAATTGTGCTGACTCAGTCTCCA GGCACCCTGTCCTTGTCTCCAGGGG AAAAGAGCCACCCTCCTGCAGGG CCAGTCAGAGTATTAGCGGCAGTT ACTTAGCCTGGTACCAGCAGAAAC GTGGCCAGGCTCCCAGGCTCCTCA TCTATGATGCGTCCAGCAGGGCCG AAGGCATCCCAGACAGGTTCATTG GCAGTGGGTCTGGGACAGACTTCA CTCTCACCATCAGCAGACTGGAGC CTGAAGACTTTGCTATGTATTACTG TCAGCAGTATGGTAGCTCACCAAT ATTCACTTTCGGCCCTGGGACCAA AGTGGATATCAAACGTACTGTGGC TGCTCCCTCCGTGTTCATTTTTCCTC CGTCGGACGAACAGCTGAAGTCCG GAACCGCGTCCGTGGTCTGTCTCCT GAACAACTTCTATCCGCGCGAGGC GAAAGTGCAGTGGAAGGTCGACAA CGCACTGCAGTCGGGAAACTCCCA GGAATCGGTGACCGAGCAGGACTC GAAGGACTCAACCTACTCATTGTC CTCCACCCTCACCCTGAGCAAGGC CGATTACGAGAAGCATAAGGTCTA CGCCTGCGAAGTGACCCACCAGGG CCTGAGCAGCCCAGTGACGAAGTC CTTCAACCGGGGAGAATGC |
| SEQ ID 1723 | GAGGTGCAGCTGGTGGAGTCTGGGG GAGGCGTGGTCCAGCCTGGGAGGTC CCTGAGACTCTCCTGTGCAGCCTCTG GATTCACCTTCAGTAGCTATGCTATG CACTGGGTCCGCCAGGCTCCAGGCA AGGGGCTGGAGTGGGTGGCAGTTAT ATCATATGATGGAAGTAATAAATACT ACGCAGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCCCGGTCGAGCCCCT GGGGGGAGTTATCGTTATACCAGGG GGCTTTTGATATCTGGGGCCAAGGGA CAATGTCACCGTCTCTTCAGCATCC ACCAAGGGGCCTTCCGTGTTCCCCCT GGCCCCCTTCATCCAAGTCGACCTCTG GTGGAACCGCCGCACTCGGTTGCCTG GTCAAAGACTACTTCCCCGAGCCCGT GACTGTCTCGTGGAACTCGGGCGCCC | SEQ ID 1831 | GAAATTGTGCTGACTCAGTCTCCA GACTCCCTGCCCGTCACCCCTGGA GAGCCGGCCTCCATCTCCTGCAGG TCTAGTCAGAGCCTCCTGCATAGTA ATGGAAACAACTATTTGGATTGGT ACCTGCAGAAGCCAGGGCAGTCTC CACAGCTCCTGATCTATTTGGGTTC TAATCGGGCCTCCGGGGTCCCTGA CAGGTTCAGTGGCAGTGGATCAGG CACAGATTTTACACTGAAACTCAG CAGAGTGGAGGCTGAGGATGTTGG GGTTTATTACTGCATGCAAGGTCTA CAAATCCCTATCACTTTCGGCCCTG GACCAAAGTGGATATCAAACGTA CTGTGGCTGCTCCCTCCGTGTTCAT TTTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
|  | TCACATCCGGAGTGCATACCTTTCCC GCCGTGTTGCAGTCCAGCGGCCTGTA CAGCCTGAGCTCCGTCGTGACAGTGC CGTCCTCCTCCCTTGGAACCCAGACC TATATCTGCAACGTCAATCACAAGCC CTCCAACACCAAAGTGGACAAGAAG GTCGAACCCAAGTCCTGCGACAAGA CTCACACCTGTCCGCCTTGTCCAGCC CCTGAGCTGCTGGGTGGTCCGTCCGT GTTCCTCTTCCCGCCCAAGCCGAAGG ACACTCTGATGATTTCACGCACCCCG GAAGTCACTTGCGTGGTCGTGGACGT GTCGCACGAAGATCCCGAAGTGAAA TTCAATTGGTACGTGGATGGGGTCGA AGTGCACAACGCCAAGACCAAGCCT AGGGAAGAACAGTACAACTCTACGT ACCGGGTGGTGTCCGTGCTGACCGTG CTGCACCAGGACTGGCTGAACGGAA AGGAGTACAAGTGCAAAGTGTCAAA CAAGGCTCTCCCTGCCCCTATCGAAA AGACCATCAGCAAGGCCAAGGGTCA ACCTAGGGAGCCCCAGGTCTATACTT TGCCGCCTAGCCGGGAAGAAATGAC TAAGAACCAAGTGTCCCTGACTTGCC TTGTCAAGGGCTTTTATCCGTCCGAC ATCGCCGTGGAGTGGGAGTCCAACG GACAACCGGAGAACAACTACAAGAC CACCCCACCGGTGCTCGATTCCGATG GCTCCTTCTTCCTGTACTCCAAGCTG ACTGTGGACAAGTCAAGATGGCAGC AGGGAAACGTGTTCTCCTGCTCCGTG ATGCACGAAGCGCTGCACAACCATT ACACCCAGAAATCACTGTCACTTTCG CCGGGAAAA |  | AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1724 | CAGATCACCTTGAAGGAGTCTGGGG GAGGCTTGGTACAGCCTGGCAGGTC CCTGAGACTCTCCTGTGCAGCCTCTG GATTCACCTTTGATGATTATGCCATG CACTGGGTCCGGCAAGCTCCAGGGA AGGGGCTGGAGTGGGTCTCAGCTATT AGTGGTAGTGGTGGTAGCACATACT ACGCAGACTCCGTGAAGGGCCGGTT CACCATCTCCAGAGACAATTCCAAG AACACGCTGTATCTGCAAATGAACA GCCTGAGAGCCGAGGACACGGCCGT ATATTACTGTGCGAAAGATAACGATT TTTGGAGTGGGAAAGTCTTTGACTAC TGGGGCCAGGGCACCCTGGTCACCG TCTCCTCAGCATCCACCAAGGGGCCT TCCGTGTTCCCCCTGGCCCCTTCATC CAAGTCGACCTCTGGTGGAACCGCC GCACTCGGTTGCCTGGTCAAAGACTA CTTCCCCGAGCCCGTGACTGTCTCGT GGAACTCGGGCGCCCTCACATCCGG AGTGCATACCTTTCCCGCCGTGTTGC AGTCCAGCGGCCTGTACAGCCTGAG CTCCGTCGTGACAGTGCCGTCCTCCT CCCTTGGAACCCAGACCTATATCTGC AACGTCAATCACAAGCCCTCCAACA CCAAAGTGGACAAGAAGGTCGAACC CAAGTCCTGCGACAAGACTCACACCT GTCCGCCTTGTCCAGCCCCTGAGCTG CTGGGTGGTCCGTCCGTGTTCCTCTT CCCGCCCAAGCCGAAGGACACTCTG ATGATTTCACGCACCCCGGAAGTCAC TTGCGTGGTCGTGGACGTGTCGCACG AAGATCCCGAAGTGAAATTCAATTG GTACGTGGATGGGGTCGAAGTGCAC AACGCCAAGACCAAGCCTAGGGAAG AACAGTACAACTCTACGTACCGGGT GGTGTCCGTGCTGACCGTGCTGCACC AGGACTGGCTGAACGGAAAGGAGTA CAAGTGCAAAGTGTCAAACAAGGCT CTCCCTGCCCCTATCGAAAAGACCAT | SEQ ID 1832 | GACATCCAGATGACCCAGTCTCCA TCTTCTGTGTCTGCATCTGTGGGAG ACAGAGTCACCATCACTTGTCGGG CGAGTCAGAACATTCGCCACTGGT TAGTCTGGTATCAGCAAAAATTAG GGCAAGCCCCTAAACTCCTGATCT ATGCTGCGTCCAATTTGCAAAGTG GGGTCCCGTCAAGGTTCAGCGGCA GTGGATCTGGGACAGAATTCACTC TCACAATCAACAGCCTGCAGGCTG AAGATTTTGCAACCTATTACTGTCT ACAGCATAACAGTTACCCGTGGAC GTTCGGCCAAGGGACCAAGGTGGA AATCAAACGTACTGTGGCTGCTCC CTCCGTGTTCATTTTTCCTCCGTCG GACGAACAGCTGAAGTCCGGAACC GCGTCCGTGGTCTGTCCTGAACA ACTTCTATCCGCGCGAGGCGAAAG TGCAGTGGAAGGTCGACAACGCAC TGCAGTCGGGAAACTCCCAGGAAT CGGTGACCGAGCAGGACTCGAAGG ACTCAACCTACTCATTGTCCTCCAC CCTCACCCTGAGCAAGGCCGATTA CGAGAAGCATAAGGTCTACGCCTG CGAAGTGACCCACCAGGGCCTGAG CAGCCCAGTGACGAAGTCCTTCAA CCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CAGCAAGGCCAAGGGTCAACCTAGG<br>GAGCCCCAGGTCTATACTTTGCCGCC<br>TAGCCGGGAAGAAATGACTAAGAAC<br>CAAGTGTCCCTGACTTGCCTTGTCAA<br>GGGCTTTTATCCGTCCGACATCGCCG<br>TGGAGTGGGAGTCCAACGGACAACC<br>GGAGAACAACTACAAGACCACCCCA<br>CCGGTGCTCGATTCCGATGGCTCCTT<br>CTTCCTGTACTCCAAGCTGACTGTGG<br>ACAAGTCAAGATGGCAGCAGGGAAA<br>CGTGTTCTCCTGCTCCGTGATGCACG<br>AAGCGCTGCACAACCATTACACCCA<br>GAAATCACTGTCACTTTCGCCGGGAA<br>AA | | |
| SEQ ID<br>1725 | GAAGTGCAGCTGGTGCAGTCTGGGG<br>GAGGCTTGGTACAGCCTGGGGGGTC<br>CCTGAGACTCTCCTGTGCAGCCTCTG<br>GATTCACCTTCAGTAGTTATAGCATG<br>AACTGGGTCCGCCAGGCTCCAGGGA<br>AGGGGCTGGAGTGGGTTTCATACATC<br>AGTAGTACTAGTAGTACCATATACTA<br>CGCAGACTCCGTGAAGGGCCGATTC<br>ACCATCTCCAGAGACAATTCCAAGA<br>ATATGCTGTTTCTACAAATGAACAGC<br>CTGAGAGCTGAGGACACGGCTGTGT<br>ATTACTGTGCGAAAGAAGGGGGCAG<br>TGGCTGGCGCCACTACTTTGACTACT<br>GGGGCCAGGGAACCCTGGTCACCGT<br>CTCCTCAGCATCCACCAAGGGGCCTT<br>CCGTGTTCCCCCTGGCCCCTTCATCC<br>AAGTCGACCTCTGGTGGAACCGCCG<br>CACTCGGTTGCCTGGTCAAAGACTAC<br>TTCCCCGAGCCCGTGACTGTCTCGTG<br>GAACTCGGGCGCCCTCACATCCGGA<br>GTGCATACCTTTCCCGCCGTGTTGCA<br>GTCCAGCGGCCTGTACAGCCTGAGCT<br>CCGTCGTGACAGTGCCGTCCTCCTCC<br>CTTGGAACCCAGACCTATATCTGCAA<br>CGTCAATCACAAGCCCTCCAACACCA<br>AAGTGGACAAGAAGGTCGAACCCAA<br>GTCCTGCGACAAGACTCACACCTGTC<br>CGCCTTGTCCAGCCCCTGAGCTGCTG<br>GGTGGTCCGTCCGTGTTCCTCTTCCC<br>GCCCAAGCCGAAGGACACTCTGATG<br>ATTTCACGCACCCCGGAAGTCACTTG<br>CGTGGTCGTGGACGTGTCGCACGAA<br>GATCCCGAAGTGAAATTCAATTGGTA<br>CGTGGATGGGTCGAAGTGCACAAC<br>GCCAAGACCAAGCCTAGGGAAGAAC<br>AGTACAACTCTACGTACCGGGTGGTG<br>TCCGTGCTGACCGTGCTGCACCAGGA<br>CTGGCTGAACGGAAAGGAGTACAAG<br>TGCAAAGTGTCAAACAAGGCTCTCCC<br>TGCCCCTATCGAAAAGACCATCAGC<br>AAGGCCAAGGGTCAACCTAGGGAGC<br>CCCAGGTCTATACTTTGCCGCCTAGC<br>CGGGAAGAAATGACTAAGAACAAG<br>TGTCCCTGACTTGCCTTGTCAAGGGC<br>TTTTATCCGTCCGACATCGCCGTGGA<br>GTGGAGTCCAACGGACAACCGGAG<br>AACAACTACAAGACCACCCCACCGG<br>TGCTCGATTCCGATGGCTCCTTCTTC<br>CTGTACTCCAAGCTGACTGTGGACAA<br>GTCAAGATGGCAGCAGGGAAACGTG<br>TTCTCCTGCTCCGTGATGCACGAAGC<br>GCTGCACAACCATTACACCCAGAAA<br>TCACTGTCACTTTCGCCGGGAAAA | SEQ ID<br>1833 | GAAATTGTGTTGACGCAGTCTCCA<br>GACTTTCAGTCTGTGACTCCAAAGC<br>AGAAAGTCACCATCACCTGCCGGG<br>CCAGTCAGAGCATTGGTGGTAGCT<br>TACACTGGTACCAGCAGAAACCAG<br>GTCAGTCTCCAAAGCTCATCATCA<br>AGTATGCTTCCCAGTCCTTCTCAGG<br>GGTCCCCTCGAGGTTCAGTGGCAG<br>TGGATCTGGGACAGATTTCACCCTC<br>ACCATCGATAGCCTGGAGGCTGAA<br>GATGCTGCAACGTACTATTGTCATC<br>AGAGTATCAGTTTACCGCTCACTTT<br>CGGCGGAGGGACCAAAGTGGATAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTCGA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |
| SEQ ID<br>1726 | CAGGTCACCTTGAAGGAGTCTGGGG<br>GAGGCGTGGTCCAGCCTGGGAGGTC<br>CCTGAGACTGTCCTGTGCAGCCTCTG<br>GATTCACCTTCAGCAGCTATGCTATG<br>CACTGGGTCCGCCAGGCTCCAGGCA<br>AGGGGCTGGAGTGGGTGGCAGTTAT | SEQ ID<br>1834 | GAAACGACACTCACGCAGTCTCCA<br>GGCACCCTGTCTTTGTCTCCAGGGG<br>AAGGAGCCACCCTCTCCTGCAGGG<br>CCAGTCAGAGTGTTACCAGCAACT<br>ACTTAGCCTGGTACCAGCAGAAAC<br>CTGGCCAGGCTCCCAGGCTCCTCAT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ATCATATGATGGAAGTAATAAATACT ACGCAGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCGAGAGATTATTGTA GTAGTACCAGCTGCCAGAACTGGTTC GACCCCTGGGGCCAGGGCACCCTGG TCACCGTCTCCTCAGCATCCACCAAG GGGCCTTCCGTGTTCCCCCTGGCCCC TTCATCCAAGTCGACCTCTGGTGGAA CCGCCGCACTCGGTTGCCTGGTCAAA GACTACTTCCCCGAGCCCGTGACTGT CTCGTGGAACTCGGGCGCCCTCACAT CCGGAGTGCATACCTTTCCCGCCGTG TTGCAGTCCAGCGGCCTGTACAGCCT GAGCTCCGTCGTGACAGTGCCGTCCT CCTCCCTTGGAACCCAGACCTATATC TGCAACGTCAATCACAAGCCCTCCAA CACCAAAGTGGACAAGAAGGTCGAA CCCAAGTCCTGCGACAAGACTCACA CCTGTCCGCCTTGTCCAGCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | | CTATGGTGCATCCTACAGGGCCAC TGGCATCCCTGACAGGTTCAGCGG CAGTGGGTCTGGGACAGACTTCAC TCTCACCATCAGCAGACTGGAGCC TGAAGATTTTGCAGTGTATTACTGT CAGCAGTATGCTAGCTCAGTCACC TTCGGCCAAGGGACACGACTGGAG ATTAAACGTACTGTGGCTGCTCCCT CCGTGTTCATTTTTCCTCCGTCGGA CGAACAGCTGAAGTCCGGAACCGC GTCCGTGGTCTGTCTCCTGAACAAC TTCTATCCGCGCGAGGCGAAAGTG CAGTGGAAGGTCGACAACGCACTG CAGTCGGGAAACTCCCAGGAATCG GTGACCGAGCAGGACTCGAAGGAC TCAACCTACTCATTGTCCTCCACCC TCACCCTGAGCAAGGCCGATTACG AGAAGCATAAGGTCTACGCCTGCG AAGTGACCCACCAGGGCCTGAGCA GCCCAGTGACGAAGTCCTTCAACC GGGGAGAATGC |
| SEQ ID 1727 | CAGGTCCAGCTGGTGCAGTCTGGGG GAGGCTTGGTACAGCCTGGGGGGTC CCTGAGACTCTCCTGTGCAGCCTCTG GATTCACCTTTAGCAACTATGTCATG AGCTGGGTCCGCCAGGCTCCAGGGA AGGGGCTGGAGTGGGTCTCAGCTATT AGTGGTATTGGTGATACTACATACTA CGCGGACTCCGTGAAGGGCCGATTC ACCATCTCCAGAGACAACGCCAAGA ACACGCTGTATCTGCAAATGAACAGT CTGAGAGCCGAGGACACGGCTGTGT ATTACTGTGCAAGAGGGCGCGTGGC GGGGGATGCTTTTGATATCTGGGGCC AAGGGACAATGGTGACCGTCTCTTCA GCATCCACCAAGGGGCCTTCCGTGTT CCCCCTGGCCCCTTCATCCAAGTCGA CCTCTGGTGGAACCGCCGCACTCGGT TGCCTGGTCAAAGACTACTTCCCCGA GCCCGTGACTGTCTCGTGGAACTCGG GCGCCCTCACATCCGGAGTGCATACC TTTCCCGCCGTGTTGCAGTCCAGCGG CCTGTACAGCCTGAGCTCCGTCGTGA CAGTGCCGTCCTCCTCCCTTGGAACC CAGACCTATATCTGCAACGTCAATCA CAAGCCCTCCAACACCAAAGTGGAC | SEQ ID 1835 | GATGTTGTGATGACTCAGTCTCCAG CCACCCTGTCTGTGTCTCCAGGGGA AAGAGCCACCCTCTCCTGCAGGGC CAGTCAGAGTATTAGCAGCAACTT AGCCTGGTACCAGCAGAAACCTGG CCAGGCTCCCAGGCTCCTCATCTAT GGTGCCTCCACCAGGGCCACTGGT ATCCCAGCCAGGTTCAGTGGCAGT GGGTCTGGGACAGAGTTCACTCTC ACCATCAGCAGCCTGCAGTCTGAA GATTTTGCAGTTTATTACTGTCAGC AGTATAATAACTGGCCTAGAACGT TCGGCCAAGGGACCAAGCTGGAGA TCAAACTACTGTGGCTGCTCCCTC CGTGTTCATTTTTCCTCCGTCGGAC GAACAGCTGAAGTCCGGAACCGCG TCCGTGGTCTGTCTCCTGAACAACT TCTATCCGCGCGAGGCGAAAGTGC AGTGGAAGGTCGACAACGCACTGC AGTCGGGAAACTCCCAGGAATCGG TGACCGAGCAGGACTCGAAGGACT CAACCTACTCATTGTCCTCCACCCT CACCCTGAGCAAGGCCGATTACGA GAAGCATAAGGTCTACGCCTGCGA AGTGACCCACCAGGGCCTGAGCAG |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AAGAAGGTCGAACCCAAGTCCTGCG<br>ACAAGACTCACACCTGTCCGCCTTGT<br>CCAGCCCCTGAGCTGCTGGGTGGTCC<br>GTCCGTGTTCCTCTTCCCGCCCAAGC<br>CGAAGGACACTCTGATGATTTCACGC<br>ACCCCGGAAGTCACTTGCGTGGTCGT<br>GGACGTGTCGCACGAAGATCCCGAA<br>GTGAAATTCAATTGGTACGTGGATGG<br>GGTCGAAGTGCACAACGCCAAGACC<br>AAGCCTAGGGAAGAACAGTACAACT<br>CTACGTACCGGGTGGTGTCCGTGCTG<br>ACCGTGCTGCACCAGGACTGGCTGA<br>ACGGAAAGGAGTACAAGTGCAAAGT<br>GTCAAACAAGGCTCTCCCTGCCCCTA<br>TCGAAAAGACCATCAGCAAGGCCAA<br>GGGTCAACCTAGGGAGCCCCAGGTC<br>TATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | CCCAGTGACGAAGTCCTTCAACCG<br>GGGAGAATGC |
| SEQ ID<br>1728 | CAGCTGCAGCTGCAGGAGTCGGGGG<br>GAGGCTTGGTACAGCCTGGGGGGTC<br>CCTGAGACTCTCCTGTGCAGCCTCTG<br>GATTCACCTTTAGCAGCTATGCCATG<br>AGCTGGGTCCGCCAGGCTCCAGGGA<br>AGGGGCTGGAGTGGGTCTCAGCTATT<br>AGTGGTAGTGGTGGTAGCACATACT<br>ACGCAGACTCCGTGAAGGGCCGGTT<br>CACCATCTCCAGAGACAATTCCAAG<br>AACACGCTGTATCTGCAAATGAACA<br>GCCTGAGAGCCGAGGACACGGCCGT<br>ATATTACTGTGCGAAAGATCAAGGG<br>GCAGCAGCTGGTACCCTGGGGTACTT<br>TGACTACTGGGGCCAGGGAACCCTG<br>GTGACCGTCTCCTCAGCATCCACCAA<br>GGGGCCTTCCGTGTTCCCCCTGGCCC<br>CTTCATCCAAGTCGACCTCTGGTGGA<br>ACCGCCGCACTCGGTTGCCTGGTCAA<br>AGACTACTTCCCCGAGCCCGTGACTG<br>TCTCGTGGAACTCGGGCGCCCTCACA<br>TCCGGAGTGCATACCTTTCCCGCCGT<br>GTTGCAGTCCAGCGGCCTGTACAGCC<br>TGAGCTCCGTCGTGACAGTGCCGTCC<br>TCCTCCCTTGGAACCCAGACCTATAT<br>CTGCAACGTCAATCACAAGCCCTCCA<br>ACACCAAAGTGGACAAGAAGGTCGA<br>ACCCAAGTCCTGCGACAAGACTCAC<br>ACCTGTCCGCCTTGTCCAGCCCCTGA<br>GCTGCTGGGTGGTCCGTCCGTGTTCC<br>TCTTCCCGCCCAAGCCGAAGGACACT<br>CTGATGATTTCACGCACCCCGGAAGT<br>CACTTGCGTGGTCGTGGACGTGTCGC<br>ACGAAGATCCCGAAGTGAAATTCAA<br>TTGGTACGTGGATGGGGTCGAAGTG<br>CACAACGCCAAGACCAAGCCTAGGG<br>AAGAACAGTACAACTCTACGTACCG<br>GGTGGTGTCCGTGCTGACCGTGCTGC<br>ACCAGGACTGGCTGAACGGAAAGGA<br>GTACAAGTGCAAAGTGTCAAACAAG<br>GCTCTCCCTGCCCCTATCGAAAAGAC<br>CATCAGCAAGGCCAAGGGTCAACCT<br>AGGGAGCCCCAGGTCTATACTTTGCC<br>GCCTAGCCGGGAAGAAATGACTAAG<br>AACCAAGTGTCCCTGACTTGCCTTGT<br>CAAGGGCTTTTATCCGTCCGACATCG<br>CCGTGGAGTGGGAGTCCAACGGACA | SEQ ID<br>1836 | GACATCCAGTTGACCCAGTCTCCA<br>GACTCCCTGGCTGTGTCTCTGGGCG<br>AGAGGGCCACCATCAACTGCAAGT<br>CCAGCCAGAGTGTTTTATACAGCTC<br>CAACAATAAGAACTACTTAGCTTG<br>GTACCAGCAGAAACCAGGACAGCC<br>TCCTAAGCTGCTCATTTACTGGGCA<br>TCTGCCCGGGAATCCGGGGTCCCT<br>GACCGATTCAGTGGCAGCGGGTCT<br>GGGACAGATTTCACTCTCACCATC<br>AACAGCCTGCAGGCTGAAGATGTG<br>GCAGTTTATTACTGTCAGCAATTTT<br>ATAGTCCTCCTCGGACGTTCGGCCA<br>AGGGACCAAGGTGGAAATCAAACG<br>TACTGTGGCTGCTCCCTCCGTGTTC<br>ATTTTTCCTCCGTCGGACGAACAGC<br>TGAAGTCCGGAACCGCGTCCGTGG<br>TCTGTCTCCTGAACAACTTCTATCC<br>GCGCGAGGCGAAAGTGCAGTGGAA<br>GGTCGACAACGCACTGCAGTCGGG<br>AAACTCCCAGGAATCGGTGACCGA<br>GCAGGACTCGAAGGACTCAACCTA<br>CTCATTGTCCTCCACCCTCACCCTG<br>AGCAAGGCCGATTACGAGAAGCAT<br>AAGGTCTACGCCTGCGAAGTGACC<br>CACCAGGGCCTGAGCAGCCCAGTG<br>ACGAAGTCCTTCAACCGGGGAGAA<br>TGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACCGGAGAACAACTACAAGACCACC CCACCGGTGCTCGATTCCGATGGCTC CTTCTTCCTGTACTCCAAGCTGACTG TGGACAAGTCAAGATGGCAGCAGGG AAACGTGTTCTCCTGCTCCGTGATGC ACGAAGCGCTGCACAACCATTACAC CCAGAAATCACTGTCACTTTCGCCGG GAAAA | | |
| SEQ ID 1729 | CAGGTGCAGCTGGTGCAGTCTGGGG CTGAGGTGAAGAAGCCTGGGGCCTC AGTGAAGGTCTCCTGCAAGGCTTCTG GATACACCTTCACCAGTTATGATATC AACTGGGTGCGACAGGCCACTGGAC AAGGGCTTGAGTGGATGGGATGGAT GAACCCTAACAGTGGTAACACAGGC TATGCACAGAAGTTCCAGGGCAGAG TCACCATGACCAGGAACACCTCCATA AGCACAGCCTACATGGAGCTGAGCA GCCTGAGATCTGAGGACACGGCCGT GTATTACTGTACGAGAGGAATCTATG ATAGTAGTGGTTCTTCCAATCCCTTT GACTCCTGGGGCCAGGGAACCCTGG TGACCGTCTCCTCAGCATCCACCAAG GGGCCTTCCGTGTTCCCCCTGGCCCC TTCATCCAAGTCGACCTCTGGTGGAA CCGCCGCACTCGGTTGCCTGGTCAAA GACTTCTTCCCCGAGCCCGTGACTGT CTCGTGGAACTCGGGCGCCCTCACAT CCGGAGTGCATACCTTTCCCGCCGTG TTGCAGTCCAGCGGCCTGTACAGCCT GAGCTCCGTCGTGACAGTGCCGTCCT CCTCCCTTGGAACCCAGACCTATATC TGCAACGTCAATCACAAGCCCTCCAA CACCAAAGTGGACAAGAAGGTCGAA CCCAAGTCCTGCGACAAGACTCACA CCTGTCCGCCTTGTCCAGCCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | SEQ ID 1837 | GAAATTGTGTTGACACAGTCTCCA GGCACCCTGTCTTTGTCTCCAGGGG AAAGAGCCACCCTCTCCTGCAGGG CCAGTCAGAGTGTTAGCAGCAGCT ACTTAGCCTGGTACCAGCAGAAAC CTGGCCAGGCTCCCAGGCTCCTCAT CTATGGTGCATCCAGCAGGGCCAC TGGCATCCCAGACAGGTTCAGTGG CAGTGGGTCTGGGACAGACTTCAC TCTCACCATCAGCAGACTGGAGCC TGAAGATTTTGCAGTGTATTACTGT CAGCAGTATGGTAGCTCACCCCCG GGCACTTTCGGCGGAGGGACCAAA GTGGATATCAAACGTACTGTGGCT GCTCCCTCCGTGTTCATTTTTCCTC CGTCGGACGAACAGCTGAAGTCCG GAACCGCGTCCGTGGTCTGTCTCCT GAACAACTTCTATCCGCGCGAGGC GAAAGTGCAGTGGAAGGTCGACAA CGCACTGCAGTCGGGAAACTCCCA GGAATCGGTGACCGAGCAGGACTC GAAGGACTCAACCTACTCATTGTC CTCCACCCTCACCCTGAGCAAGGC CGATTACGAGAAGCATAAGGTCTA CGCCTGCGAAGTGACCCACCAGGG CCTGAGCAGCCCAGTGACGAAGTC CTTCAACCGGGGAGAATGC |
| SEQ ID 1730 | GAGGTGCAGCTGGTGCAGTCTGGGG CTGAGGTGAAGAAGCCTGGGGCCTC AGTGAAGATTTCCTGCGAGGCTTCTG GATACACCTTCACTGATTATGCTATA CATTGGGTGCGCCAGGCCCCCGGAC AAAGACTTGAGTGGATGGGATGGAT CAACGCTGGCGATGGTGGCACAAAA GTTCACGGGAGTTCCAGGGCAGAG TCACCATTACCAGGGACACATCCGCG ACCACAGCCTACATGGAGGTGAGCA GTCTGAGATCTGAAGACACGGCTGTC | SEQ ID 1838 | GAAATTGTGCTGACTCAGTCTCCA GGCACCCTGTCTTTGTCTCCAGGGG AAAGAGCCACCCTCTCCTGCAGGG CCAGTCAGAGTTTAAGTACCAACT TAGCCTGGTACCAGCAGAAACCTG GCCAGGCTCCCAGGCTCCTCATCTA TGGTGCATCCACCAGGGCCACTGG TATCCCAGCCAGGTTCAGTGGCAG TGGGTCTGGCACAGAGTTCACTCTC ACCATCACCAGCCTGCAGTCTGAA GATTTTGCAGTTTATTACTGTCAGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TATTACTGTGCGAGAGGATATTGTAG<br>TGGTGGTAGCTGCCCAGGAACGGAT<br>TTTGACTACTGGGGCCAGGGAACCCT<br>GGTCACCGTCTCCTCAGCATCCACCA<br>AGGGGCCTTCCGTGTTCCCCCTGGCC<br>CCTTCATCCAAGTCGACCTCTGGTGG<br>AACCGCCGCACTCGGTTGCCTGGTCA<br>AAGACTACTTCCCCGAGCCCGTGACT<br>GTCTCGTGGAACTCGGGCGCCCTCAC<br>ATCCGGAGTGCATACCTTTCCCGCCG<br>TGTTGCAGTCCAGCGGCCTGTACAGC<br>CTGAGCTCCGTCGTGACAGTGCCGTC<br>CTCCTCCCTTGGAACCCAGACCTATA<br>TCTGCAACGTCAATCACAAGCCCTCC<br>AACACCAAAGTGGACAAGAAGGTCG<br>AACCCAAGTCCTGCGACAAGACTCA<br>CACCTGTCCGCCTTGTCCAGCCCCTG<br>AGCTGCTGGGTGGTCCGTCCGTGTTC<br>CTCTTCCCGCCCAAGCCGAAGGACAC<br>TCTGATGATTTCACGCACCCCGGAAG<br>TCACTTGCGTGGTCGTGGACGTGTCG<br>CACGAAGATCCCGAAGTGAAATTCA<br>ATTGGTACGTGGATGGGGTCGAAGT<br>GCACAACGCCAAGACCAAGCCTAGG<br>GAAGAACAGTACAACTCTACGTACC<br>GGGTGGTGTCCGTGCTGACCGTGCTG<br>CACCAGGACTGGCTGAACGGAAAGG<br>AGTACAAGTGCAAAGTGTCAAACAA<br>GGCTCTCCCTGCCCCTATCGAAAAGA<br>CCATCAGCAAGGCCAAGGGTCAACC<br>TAGGGAGCCCCAGGTCTATACTTTGC<br>CGCCTAGCCGGGAAGAAATGACTAA<br>GAACCAAGTGTCCCTGACTTGCCTTG<br>TCAAGGGCTTTTATCCGTCCGACATC<br>GCCGTGGAGTGGGAGTCCAACGGAC<br>AACCGGAGAACAACTACAAGACCAC<br>CCCACCGGTGCTCGATTCCGATGGCT<br>CCTTCTTCCTGTACTCCAAGCTGACT<br>GTGGACAAGTCAAGATGGCAGCAGG<br>GAAACGTGTTCTCCTGCTCCGTGATG<br>CACGAAGCGCTGCACAACCATTACA<br>CCCAGAAATCACTGTCACTTTCGCCG<br>GGAAAA | | AGTATCATAACTGGCCTCCGTACA<br>CTTTTGGCCAGGGGACCAAGGTGG<br>AGATCAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |
| SEQ ID<br>1731 | CAGGTGCAGCTGGTGCAGTCTGGGG<br>CTGAGGTGAAGAAGCCTGGGGCCTC<br>AGTGAAGGTTTCCTGCAAGGCATCTG<br>GATACACCTTCACCAGCTACTATATG<br>CACTGGGTGCGACAGGCCCCTGGAC<br>AAGGGCTTGAGTGGATGGGAATAAT<br>CAACCCTAGTGGTGGTAGCACAAGC<br>TACGCACAGAAGTTCCAGGGCAGAG<br>TCACCATGACCAGGGACACGTCCAC<br>GAGCACAGTCTACATGGAGCTGAGC<br>AGCCTGAGATCTGAGGACACGGCCG<br>TGTATTACTGTGCGAGAGATGGTGTA<br>GGAGGGAGAGATGGCTACAATTTTG<br>ACTACTGGGGCCAGGGAACCCTGGT<br>CACCGTCTCCTCAGCATCCACCAAGG<br>GGCCTTCCGTGTTCCCCCTGGCCCCT<br>TCATCCAAGTCGACCTCTGGTGGAAC<br>CGCCGCACTCGGTTGCCTGGTCAAAG<br>ACTACTTCCCCGAGCCCGTGACTGTC<br>TCGTGGAACTCGGGCGCCCTCACATC<br>CGGAGTGCATACCTTTCCCGCCGTGT<br>TGCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC | SEQ ID<br>1839 | GACATCCAGATGACCCAGTCTCCTT<br>CCACCCTGTCTGCATCTGTAGGAG<br>ACAGAGTCACCATCACTTGCCGGG<br>CCAGTCAGAGTATTAGTAGCTGGT<br>TGGCCTGGTATCAGCAGAAACCAG<br>GGAAAGCCCCTAAGCTCCTGATCT<br>ATAAGGCGTCTAGTTTAGAAAGTG<br>GGGTCCCATCAAGGTTCAGCGGCA<br>GTGGATCTGGGACAGAATTCACTC<br>TCACCATCAGCAGCCTGCAGCCTG<br>ATGATTTTGCAACTTATTACTGCCA<br>ACAGTATAATAGTTATTGGACGTTC<br>GGCCAAGGGACCAAGGTGGAAATC<br>AAACGTACTGTGGCTGCTCCCTCCG<br>TGTTCATTTTTCCTCCGTCGGACGA<br>ACAGCTGAAGTCCGGAACCGCGTC<br>CGTGGTCTGTCTCCTGAACAACTTC<br>TATCCGCGCGAGGCGAAAGTGCAG<br>TGGAAGGTCGACAACGCACTGCAG<br>TCGGGAAACTCCCAGGAATCGGTG<br>ACCGAGCAGGACTCGAAGGACTCA<br>ACCTACTCATTGTCCTCCACCCTCA<br>CCCTGAGCAAGGCCGATTACGAGA<br>AGCATAAGGTCTACGCCTGCGAAG<br>TGACCCACCAGGGCCTGAGCAGCC<br>CAGTGACGAAGTCCTTCAACCGGG<br>GAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
|  | ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA |  |  |
| SEQ ID 1732 | GAAGTGCAGCTGGTGCAGTCTGGGG GAGGCTTGGTCCAGCCTGGGGGGTC CCTGAGACTCTCCTGTGCAGCCTCTG GATTCACCGTCAGTAGCAACTACATG AGCTGGGTCCGCCAGGCTCCAGGGA AGGGGCTGGAGTGGGTCTCAGTTATT TATAGCGGTGGTAGCACATACTACGC AGACTCCGTGAAGGGCCGATTCACC ATCTCCAGAGACAATTCCAAGAACA CGCTGTATCTTCAAATGAACAGCCTG AGAGCTGAGGACACGGCTGTGTATT ACTGTGCGAGAGCCCCCCTAGCAGC AGATGGCTACTTTGACTACTGGGGCC AGGGAACCCTGGTCACCGTCTCCTCA GCATCCACCAAGGGGCCTTCCGTGTT CCCCCTGGCCCCTTCATCCAAGTCGA CCTCTGGTGGAACGCCGCACTCGGT TGCCTGGTCAAAGACTACTTCCCCGA GCCCGTGACTGTCTCGTGGAACTCGG GCGCCCTCACATCCGGAGTGCATACC TTTCCCGCCGTGTTGCAGTCCAGCGG CCTGTACAGCCTGAGCTCCGTCGTGA CAGTGCCGTCCTCCTCCCTTGGAACC CAGACCTATATCTGCAACGTCAATCA CAAGCCCTCCAACACCAAAGTGGAC AAGAAGGTCGAACCCAAGTCCTGCG ACAAGACTCACACCTGTCCGCCTTGT CCAGCCCCTGAGCTGCTGGGTGGTCC GTCCGTGTTCCTCTTCCCGCCCAAGC CGAAGGACACTCTGATGATTTCACGC ACCCCCGGAAGTCACTTGCGTGGTCGT GGACGTGTCGCACGAAGATCCCGAA GTGAAATTCAATTGGTACGTGGATGG GGTCGAAGTGCACAACGCCAAGACC AAGCCTAGGGAAGAACAGTACAACT CTACGTACCGGGTGGTGTCCGTGCTG ACCGTGCTGCACCAGGACTGGCTGA ACGGAAAGGAGTACAAGTGCAAAGT GTCAAACAAGGCTCTCCCTGCCCCTA TCGAAAAGACCATCAGCAAGGCCAA GGGTCAACCTAGGGAGCCCCAGGTC TATACTTTGCCGCCTAGCCGGGAAGA AATGACTAAGAACCAAGTGTCCCTG ACTTGCCTTGTCAAGGGCTTTTATCC GTCCGACATCGCCGTGGAGTGGGAG TCCAACGGACAACCGGAGAACAACT ACAAGACCACCCCACCGGTGCTCGA TTCCGATGGCTCCTTCTTCCTGTACTC CAAGCTGACTGTGGACAAGTCAAGA TGGCAGCAGGGAAACGTGTTCTCCTG | SEQ ID 1840 | GAAACGACACTCACGCAGTCTCCA GGCACCCTGTCTTTGTCTCCAGGGG AAGGCGCCACCCTCTCCTGCAGGG CCAGTCACAGTGTTGGCGCCAACT ACATAGCCTGGTACCAGCAGAAAC CTGGCCAGGCTCCCAGGCTCCTTAT CCATACTGCATCCAAAAGGGCCAC TGGCGTCCCAGAGAGGTTCAGTGG CAGTGGGTCTGGGACAGACTTCAC TCTCAGTATCAGCAGACTGGAGCC TGAAGACTTTGCCGTGTATCACTGT CAGCAGTATGCTGCCGCACCGATT ACCTTCGGCCAAGGGACACGACTG GAGATTAAACGTACTGTGGCTGCT CCCTCCGTGTTCATTTTTCCTCCGT CGGACGAACAGCTGAAGTCCGGAA CCGCGTCCGTGGTCTGTCTCCTGAA CAACTTCTATCCGCGCGAGGCGAA AGTGCAGTGGAAGGTCGACAACGC ACTGCAGTCGGGAAACTCCCAGGA ATCGGTGACCGAGCAGGACTCGAA GGACTCAACCTACTCATTGTCCTCC ACCCTCACCCTGAGCAAGGCCGAT TACGAGAAGCATAAGGTCTACGCC TGCGAAGTGACCCACCAGGGCCTG AGCAGCCCAGTGACGAAGTCCTTC AACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CTCCGTGATGCACGAAGCGCTGCAC<br>AACCATTACACCCAGAAATCACTGTC<br>ACTTTCGCCGGGAAAA | | |
| SEQ ID<br>1733 | GAGGTCCAGCTGGTGCAGTCTGGGG<br>CTGAGGTGAAGAAGCCTGGGTCCTC<br>GGTGAAGGTCTCCTGCAAGGCTTCTG<br>GAGGCACCTTCAGCAGCTATGCTATC<br>AGCTGGGTGCGACAGGCCCCTGGAC<br>AAGGGCTTGAGTGGATGGGAGGGAT<br>CATCCCTATCTTTGGTACAGCAAACT<br>ACGCACAGAAGTTCCAGGGCAGAGT<br>CACGATTACCGCGGACGAATCCACG<br>AGCACAGCCTACATGGAGCTGAGCA<br>GCCTGAGATCTGAGGACACGGCCGT<br>GTATTACTGTGCGAGAGCCCGGGGG<br>CTACAGTACCTAATCTGGTACTTCGA<br>TCTCTGGGGCCGTGGCACCCTGGTGA<br>CCGTCTCCTCAGCATCCACCAAGGGG<br>CCTTCCGTGTTCCCCCTGGCCCCTTC<br>ATCCAAGTCGACCTCTGGTGAACCG<br>CCGCACTCGGTTGCCTGGTCAAAGAC<br>TACTTCCCCGAGCCCGTGACTGTCTC<br>GTGGAACTCGGGCGCCCTCACATCCG<br>GAGTGCATACCTTTCCCGCCGTGTTG<br>CAGTCCAGCGGCCTGTACAGCCTGA<br>GCTCCGTCGTGACAGTGCCGTCCTCC<br>TCCCTTGGAACCCAGACCTATATCTG<br>CAACGTCAATCACAAGCCCTCCAAC<br>ACCAAAGTGGACAAGAAGGTCGAAC<br>CCAAGTCCTGCGACAAGACTCACAC<br>CTGTCCGCCTTGTCCAGCCCCTGAGC<br>TGCTGGGTGGTCCGTCCGTGTTCCTC<br>TTCCCGCCCAAGCCGAAGGACACTCT<br>GATGATTTCACGCACCCCGGAAGTCA<br>CTTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC<br>CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA<br>ACGTGTTCTCCTGCTCCGTGATGCAC<br>GAAGCGCTGCACAACCATTACACCC<br>AGAAATCACTGTCACTTTCGCCGGGA<br>AAA | SEQ ID<br>1841 | GAAATTGTGATGACACAGTCTCCA<br>TCCTCCCTGTCTGCATCTGTGGGGG<br>ACAGAGTCATCATCACTTGCCGGG<br>CGAGTCAGGGCATTGCCAATTATTT<br>AGCCTGGTATCAGCAGAAACCAGG<br>GAAAGGTCCTAAACTCCTGATCTA<br>TGCTTCATCTACTTTGCAATCAGGG<br>GTCCCATCTCGGTTCAGTGGCAGTG<br>GATCTGGGACAGATTTCACTCTCAC<br>CATCAGCGGCCTGCAGCCTGAAGA<br>TGTTGCAACTTATTACTGTCAGAAG<br>TATAACAGTGTCCCTCTCACTTTCG<br>GCGGAGGGACCAAAGTGGATATCA<br>AACGTACTGTGGCTGCTCCCTCCGT<br>GTTCATTTTTCCTCCGTCGGACGAA<br>CAGCTGAAGTCCGGAACCGCGTCC<br>GTGGTCTGTCTCCTGAACAACTTCT<br>ATCCGCGCGAGGCGAAAGTGCAGT<br>GGAAGGTCGACAACGCACTGCAGT<br>CGGGAAACTCCCAGGAATCGGTGA<br>CCGAGCAGGACTCGAAGGACTCAA<br>CCTACTCATTGTCCTCCACCCTCAC<br>CCTGAGCAAGGCCGATTACGAGAA<br>GCATAAGGTCTACGCCTGCGAAGT<br>GACCCACCAGGGCCTGAGCAGCCC<br>AGTGACGAAGTCCTTCAACCGGGG<br>AGAATGC |
| SEQ ID<br>1734 | CAGGTCCAGCTGGTACAGTCTGGGG<br>CTGAGGTGAAGAAGCCTGGGGCCTC<br>AGTGAAGGTTTCCTGCAAGGCATCTG<br>GATACACCTTCACCAGCTACTATATG<br>CACTGGGTGCGACAGGCCCCTGGAC<br>AAGGGCTTGAGTGGATGGGAATAAT<br>CAACCCTAGTGGTGGTAGCACAAGC<br>TACGCACAGAAGTTCCAGGGCAGAG<br>TCACCATGACCAGGGACACGTCCAC<br>GAGCACAGTCTACATGGAGCTGAGC<br>AGCCTGAGATCTGAGGACACGGCCG<br>TGTATTACTGTGCGAGCCCGGGTATG<br>GTTCGGGGAGTTATTACTGCCCCGCT<br>TGACTACTGGGGCCAGGGCACCCTG<br>GTCACCGTCTCCTCAGCATCCACCAA<br>GGGGCCTTCCGTGTTCCCCCTGGCCC | SEQ ID<br>1842 | GATGTTGTGATGACTCAGTCTCCAG<br>TCTCCCTGGCTGTGTCTCTGGGCGA<br>GAGGGCCACCATCAACTGCAAGTC<br>CAGCCAGAGTGTTTTATACAGAAC<br>CAACAATAAGAACTACTTGGCTTG<br>GTATCAGCAGAAACCAGGACAGCC<br>TCCTAAGTTGCTCATTTACTGGGCA<br>TCTACCCGGGAATCCGGGGTCCCT<br>GACCGATTCAGTGGCAGCGGGTCT<br>GGGACAGATTTCACTCTCACCATC<br>AGCAGCCTGCAGCCTGAGGATGTG<br>GCAGTGTACTACTGTCAGCAATATT<br>ACAATCTTCCTCGATCTTTTGGCCA<br>GGGGACCAAGCTGGAGATCAAACG<br>TACTGTGGCTGCTCCCTCCGTGTTC<br>ATTTTTCCTCCGTCGGACGAACAGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CTTCATCCAAGTCGACCTCTGGTGGA ACCGCCGCACTCGGTTGCCTGGTCAA AGACTACTTCCCCGAGCCCGTGACTG TCTCGTGGAACTCGGGCGCCCTCACA TCCGGAGTGCATACCTTTCCCGCCGT GTTGCAGTCCAGCGGCCTGTACAGCC TGAGCTCCGTCGTGACAGTGCCGTCC TCCTCCCTTGGAACCCAGACCTATAT CTGCAACGTCAATCACAAGCCCTCCA ACACCAAAGTGGACAAGAAGGTCGA ACCCAAGTCCTGCGACAAGACTCAC ACCTGTCCGCCTTGTCCAGCCCCTGA GCTGCTGGGTGGTCCGTCCGTGTTCC TCTTCCCGCCCAAGCCGAAGGACACT CTGATGATTTCACGCACCCCGGAAGT CACTTGCGTGGTCGTGGACGTGTCGC ACGAAGATCCCGAAGTGAAATTCAA TTGGTACGTGGATGGGGTCGAAGTG CACAACGCCAAGACCAAGCCTAGGG AAGAACAGTACAACTCTACGTACCG GGTGGTGTCCGTGCTGACCGTGCTGC ACCAGGACTGGCTGAACGGAAAGGA GTACAAGTGCAAAGTGTCAAACAAG GCTCTCCCTGCCCCTATCGAAAAGAC CATCAGCAAGGCCAAGGGTCAACCT AGGGAGCCCCAGGTCTATACTTTGCC GCCTAGCCGGGAAGAAATGACTAAG AACCAAGTGTCCCTGACTTGCCTTGT CAAGGGCTTTTATCCGTCCGACATCG CCGTGGAGTGGGAGTCCAACGGACA ACCGGAGAACAACTACAAGACCACC CCACCGGTGCTCGATTCCGATGGCTC CTTCTTCCTGTACTCCAAGCTGACTG TGGACAAGTCAAGATGGCAGCAGGG AAACGTGTTCTCCTGCTCCGTGATGC ACGAAGCGCTGCACAACCATTACAC CCAGAAATCACTGTCACTTTCGCCGG GAAAA | | TGAAGTCCGGAACCGCGTCCGTGG TCTGTCTCCTGAACAACTTCTATCC GCGCGAGGCGAAAGTGCAGTGGAA GGTCGACAACGCACTGCAGTCGGG AAACTCCCAGGAATCGGTGACCGA GCAGGACTCGAAGGACTCAACCTA CTCATTGTCCTCCACCCTCACCCTG AGCAAGGCCGATTACGAGAAGCAT AAGGTCTACGCCTGCGAAGTGACC CACCAGGGCCTGAGCAGCCCAGTG ACGAAGTCCTTCAACCGGGGAGAA TGC |
| SEQ ID 1735 | GAGGTCCAGCTGGTACAGTCTGGGG GAGGCTGGTCAAGCCTGGGGGGTC CCTGAGACTCTCCTGTGCAGCCTCTG GATTCACCTTCAGCAGCTATGCTATC AGCTGGGTGCGACAGGCCCCTGGAC AAGGGCTTGAGTGGATGGGAGGGAT CATCCCTATGTATGGTACAGCAAACT ACGCACAGAAGTTCCAGGGCAGAGT CACGATTACCGCGGACGAATCCACG AGCACAGCCTACATGGAACTGAGCA GCCTGAGATCTGAGGACACGGCCCT CTATTACTGTGCGAGAGAAGCTAAGT GGGGAATGTACTACTTTGACTACTGG GGCCAGGGCACCCTGGTCACCGTCTC CTCAGCATCCACCAAGGGGCCTTCCG TGTTCCCCCTGGCCCCTTCATCCAAG TCGACCTCTGGTGAACCGCCGCACT CGGTTGCCTGGTCAAAGACTACTTCC CCGAGCCCGTGACTGTCTCGTGGAAC TCGGGCGCCCTCACATCCGGAGTGCA TACCTTTCCCGCCGTGTTGCAGTCCA GCGGCCTGTACAGCCTGAGCTCCGTC GTGACAGTGCCGTCCTCCTCCCTTGG AACCCAGACCTATATCTGCAACGTCA ATCACAAGCCCTCCAACACCAAAGT GGACAAGAAGGTCGAACCCAAGTCC TGCGACAAGACTCACACCTGTCCGCC TTGTCCAGCCCCTGAGCTGCTGGGTG GTCCGTCCGTGTTCCTCTTCCCGCCC AAGCCGAAGGACACTCTGATGATTTC ACGCACCCCGGAAGTCACTTGCGTG GTCGTGGACGTGTCGCACGAAGATC CCGAAGTGAAATTCAATTGGTACGTG GATGGGGTCGAAGTGCACAACGCCA AGACCAAGCCTAGGGAAGAACAGTA CAACTCTACGTACCGGGTGGTGTCCG | SEQ ID 1843 | GATATTGTGATGACCCACACTCCA GACTCCCTGGCTGTGTCTCTGGGCG AGAGGGCCACCATCAACTGCAAGT CCAACCGGAGTGTTTTATACAGCC CCAACAATCAGAACTACTTAGGTT GGTACCAGCAGAAGCCAGGACAGC CTCCTAAGCTGCTCATTTACTGGGC ATCTACCCGGGACTCCGGGGCCCC TGACCGATTCAGTGGCAGCGGGTC TGGGACAGATTTCACTCTCACCATC AACAGCCTGCAGGCTGAAGATGTG GCAGTTTATTACTGTCAGCAATATG CAAGTACTCCATACACTTTTGGCCA GGGGACCAAGGTGGAGATCAAACG TACTGTGGCTGCTCCCTCCGTGTTC ATTTTTCCTCCGTCGGACGAACAGC TGAAGTCCGGAACCGCGTCCGTGG TCTGTCTCCTGAACAACTTCTATCC GCGCGAGGCGAAAGTGCAGTGGAA GGTCGACAACGCACTGCAGTCGGG AAACTCCCAGGAATCGGTGACCGA GCAGGACTCGAAGGACTCAACCTA CTCATTGTCCTCCACCCTCACCCTG AGCAAGGCCGATTACGAGAAGCAT AAGGTCTACGCCTGCGAAGTGACC CACCAGGGCCTGAGCAGCCCAGTG ACGAAGTCCTTCAACCGGGGAGAA TGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TGCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | | |
| SEQ ID 1736 | GAGGTGCAGCTGGTGGAGTCCGGGG GAGGCGTGGTCCAGCTGGGAGGTC CCTGAGACTCTCCTGTGCAGCCTCTG GATTCACCTTCAGTAGCTATGCTATA CACTGGGTCCGCCAGGCTCCAGGCA AGGGGCTGGAGTGGGTGGCAATTAT ATCAGATGATGGAAGTAAGAGTTAC TACGCAGACTCCGTGCAGGGCCGATT CACCATCTCCAGAGACAATTCGAGG AACAGTATATCTGCAAATGAACA GCCTGAGAGCTGAGGACACGGCTAT GTATTACTGTGCGAGAGACAGGGGA ACTAAATGGAACCAATTGAATGATG TTTTTGATATGTGGGGCCAAGGGACA ATGGTCACCGTCTCTTCAGCATCCAC CAAGGGGCCTTCCGTGTTCCCCCTGG CCCCTTCATCCAAGTCGACCTCTGGT GGAACCGCCGCACTCGGTTGCCTGGT CAAAGACTACTTCCCCGAGCCCGTGA CTGTCTCGTGGAACTCGGGCGCCCTC ACATCCGGAGTGCATACCTTTCCCGC CGTGTTGCAGTCCAGCGGCCTGTACA GCCTGAGCTCCGTCGTGACAGTGCCG TCCTCCTCCCTTGGAACCCAGACCTA TATCTGCAACGTCAATCACAAGCCCT CCAACACCAAAGTGGACAAGAAGGT CGAACCCAAGTCCTGCGACAAGACT CACACCTGTCCGCCTTGTCCAGCCCC TGAGCTGCTGGGTGGTCCGTCCGTGT TCCTCTTCCCGCCCAAGCCGAAGGAC ACTCTGATGATTTCACGCACCCCGGA AGTCACTTGCGTGGTCGTGGACGTGT CGCACGAAGATCCCGAAGTGAAATT CAATTGGTACGTGGATGGGGTCGAA GTGCACAACGCCAAGACCAAGCCTA GGGAAGAACAGTACAACTCTACGTA CCGGGTGGTGTCCGTGCTGACCGTGC TGCACCAGGACTGGCTGAACGGAAA GGAGTACAAGTGCAAAGTGTCAAAC AAGGCTCTCCCTGCCCCTATCGAAAA GACCATCAGCAAGGCCAAGGGTCAA CCTAGGGAGCCCCAGGTCTATACTTT GCCGCCTAGCCGGGAAGAAATGACT AAGAACCAAGTGTCCCTGACTTGCCT TGTCAAGGGCTTTTATCCGTCCGACA TCGCCGTGGAGTGGGAGTCCAACGG ACAACCGGAGAACAACTACAAGACC ACCCCACCGGTGCTCGATTCCGATGG CTCCTTCTTCCTGTACTCCAAGCTGA CTGTGGACAAGTCAAGATGGCAGCA GGGAAACGTGTTCTCCTGCTCCGTGA TGCACGAAGCGCTGCACAACCATTA CACCCAGAAATCACTGTCACTTTCGC CGGGAAAA | SEQ ID 1844 | GATGTTGTGATGACTCAGTCTCCAG CCACCCTGTCTTTGTCTCCAGGGGA AAGAGCCACCCTCTCCTGCAGGGC CAGTGAGAGTGTTAATAGCAACTT CTTAGCCTGGTACCAGCAGAAACC TGGCCAGGCTCCCAGGCTCCTCATC TATGCTGCATCCACCAGGGCCACT GGTATCCCAGCCAGGTTCAGTGGC AGTGGGTCTGGGACAGAGTTCACT CTCATCATCACCAGCCTGCAGTCTG AAGATTTTGCAGTTTATTACTGTCA GCAGTATAATAACTGGCCGCTCAC TTTCGGCGGAGGGACCAAGCTGGA GATCAAACGTACTGTGGCTGCTCC CTCCGTGTTCATTTTTCCTCCGTCG GACGAACAGCTGAAGTCCGGAACC GCGTCCGTGGTCTGTCTCCTGAACA ACTTCTATCCGCGCGAGGCGAAAG TGCAGTGGAAGGTCGACAACGCAC TGCAGTCGGAAACTCCCAGGAAT CGGTGACCGAGCAGGACTCGAAGG ACTCAACCTACTCATTGTCCTCCAC CCTCACCCTGAGCAAGGCCGATTA CGAGAAGCATAAGGTCTACGCCTG CGAAGTGACCCACCAGGGCCTGAG CAGCCCAGTGACGAAGTCCTTCAA CCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
| --- | --- | --- | --- |
| SEQ ID 1737 | CAGATGCAGCTGGTGCAATCTGGGG CTGAGGTGAAGAAGCCTGGGGCCTC AGTGAAGGTCTCCTGCACGGCTTCTG GATACACCTTCACCAGTTCTGATATC AACTGGGTGCGACAGGCCACTGGAC AAGGGCTTGAGTGGATGGGATGGAT GAACCCTAACAGTGGTAACACCGGC TATGCAGAGAAGTTCCAGGGCAGGG TCACCATGACCAGCGACTCCTCCATA AGCACCGCCTACATGGAGTTGAGAA GCCTGACCACTGAGGACACGGCCGT ATATTACTGTGCGAGAGGTGGGGGT GCGAGCTATACTGACTCCTGGGGCCA GGGCACCCTGGTCACCGTCTCCTCAG CATCCACCAAGGGGCCTTCCGTGTTC CCCCTGGCCCCTTCATCCAAGTCGAC CTCTGGTGGAACCGCCGCACTCGGTT GCCTGGTCAAAGACTACTTCCCCGAG CCCGTGACTGTCTCGTGGAACTCGGG CGCCCTCACATCCGGAGTGCATACCT TTCCCGCCGTGTTGCAGTCCAGCGGC CTGTACAGCCTGAGCTCCGTCGTGAC AGTGCCGTCCTCCTCCCTTGGAACCC AGACCTATATCTGCAACGTCAATCAC AAGCCCTCCAACACCAAAGTGGACA AGAAGGTCGAACCCAAGTCCTGCGA CAAGACTCACACCTGTCCGCCTTGTC CAGCCCCTGAGCTGCTGGGTGGTCCG TCCGTGTTCCTCTTCCCGCCCAAGCC GAAGGACACTCTGATGATTTCACGCA CCCCGGAAGTCACTTGCGTGGTCGTG GACGTGTCGCACGAAGATCCCGAAG TGAAATTCAATTGGTACGTGGATGGG GTCGAAGTGCACAACGCCAAGACCA AGCCTAGGGAAGAACAGTACAACTC TACGTACCGGGTGGTGTCCGTGCTGA CCGTGCTGCACCAGGACTGGCTGAA CGGAAAGGAGTACAAGTGCAAAGTG TCAAACAAGGCTCTCCCTGCCCCTAT CGAAAAGACCATCAGCAAGGCCAAG GGTCAACCTAGGGAGCCCCAGGTCT ATACTTTGCCGCCTAGCCGGGAAGA AATGACTAAGAACCAAGTGTCCCTG ACTTGCCTTGTCAAGGGCTTTTATCC GTCCGACATCGCCGTGGAGTGGGAG TCCAACGGACAACCGGAGAACAACT ACAAGACCACCCCACCGGTGCTCGA TTCCGATGGCTCCTTCTTCCTGTACTC CAAGCTGACTGTGGACAAGTCAAGA TGGCAGCAGGGAAACGTGTTCTCCTG CTCCGTGATGCACGAAGCGCTGCAC AACCATTACACCCAGAAATCACTGTC ACTTTCGCCGGGAAAA | SEQ ID 1845 | GATGTTGTGATGACTCAGTCTCCAG CCACCCTGTCTTTGTCTCCAGGGGA AAGAGCCACCCTCTCCTGCAGGGC CAGTCAGAGTGTTAGCAGCTACTT AGCCTGGTACCAACAGAAACCTGG CCAGGCTCCCAGGCTCCTCATCTAT GATGCATCCAACAGGGCCACTGGC ATCCCAGCCAGGTTCAGTGGCAGT GGGTCTGGGACAGACTTCACTCTC ACCATCAGCAGCCTAGAGCCTGAA GATTTTGCAGTTTATTACTGTCAGC AGCGTAGCAACTGGTCGCTCACTTT CGGCGGAGGGACCAAGCTGGAGAT CAAACGTACTGTGGCTGCTCCCTCC GTGTTCATTTTTCCTCCGTCGGACG AACAGCTGAAGTCCGGAACCGCGT CCGTGGTCTGTCTCCTGAACAACTT CTATCCGCGCGAGGCGAAAGTGCA GTGGAAGGTCGACAACGCACTGCA GTCGGGAAACTCCCAGGAATCGGT GACCGAGCAGGACTCGAAGGACTC AACCTACTCATTGTCCTCCACCCTC ACCCTGAGCAAGGCCGATTACGAG AAGCATAAGGTCTACGCCTGCGAA GTGACCCACCAGGGCCTGAGCAGC CCAGTGACGAAGTCCTTCAACCGG GGAGAATGC |
| SEQ ID 1738 | CAGGTCCAGCTGGTGCAGTCTGGGG GAGGCTTGGTACAGCCAGGGCGGTC CCTGAGACTCTCCTGTACAGCTTCTG GATTCACCTTTGGTGATTATGCTATG AGCTGGTTCCGCCAGGCTCCAGGGA AGGGGCTGGAGTGGGTAGGTTTCATT AGAAGCAAAGCTTATGGTGGGACAA CAGAATACGCCGCGTCTGTGAAAGG CAGATTCACCATCTCAAGAGATGATT CCAAAAGCATCGCCTATCTGCAAATG AACAGCCTGAAAACCGAGGACACAG CCGTGTATTACTGTACCGCTAAGGGG GGCTACGTCGGATACAGCTATGGAC CTTTTGGGGGCTACTGGGGCCAGGG AACCCTGGTCACCGTCTCCTCAGCAT CCACCAAGGGGCCTTCCGTGTTCCCC CTGGCCCCTTCATCCAAGTCGACCTC TGGTGGAACCGCCGCACTCGGTTGCC TGGTCAAAGACTACTTCCCCGAGCCC GTGACTGTCTCGTGGAACTCGGGCGC CCTCACATCCGGAGTGCATACCTTTC | SEQ ID 1846 | GAAACGACACTCACGCAGTCTCCA GGCACCCTGTCTTTGTCTCCAGGGG AAAGAGCCACCCTCTCCTGCAGGG CCAGTCAGAGTGTTAGCAGCAGCT ACTTAGCCTGGTACCAACAGAAAC CTGGCCAGGCTCCCAGGCTCCTCAT CTATGGTGCTTCCACCAGGGCCACT GGCATCCCAGACAGGTTCAGTGGC AGTGGGTCTGGGACGGACTTCACT CTCACCATCGGCAGACTGGAGCCT GAAGATTTTGCAGTGTATTACTGTC AACACTATCCCTCACGTCGGA TCACCTTCGGCCAAGGGACACGAC TGGAGATTAAACGTACTGTGGCTG CTCCCTCCGTGTTCATTTTTCCTCC GTCGGACGAACAGCTGAAGTCCGG AACCGCGTCCGTGGTCTGTCTCCTG AACAACTTCTATCCGCGCGAGGCG AAAGTGCAGTGGAAGGTCGACAAC GCACTGCAGTCGGGAAACTCCCAG GAATCGGTGACCGAGCAGGACTCG |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCGCCGTGTTGCAGTCCAGCGGCCTG<br>TACAGCCTGAGCTCCGTCGTGACAGT<br>GCCGTCCTCCTCCCTTGGAACCCAGA<br>CCTATATCTGCAACGTCAATCACAAG<br>CCCTCCAACACCAAAGTGGACAAGA<br>AGGTCGAACCCAAGTCCTGCGACAA<br>GACTCACACCTGTCCGCCTTGTCCAG<br>CCCCTGAGCTGCTGGGTGGTCCGTCC<br>GTGTTCCTCTTCCCGCCCAAGCCGAA<br>GGACACTCTGATGATTTCACGCACCC<br>CGGAAGTCACTTGCGTGGTCGTGGAC<br>GTGTCGCACGAAGATCCCGAAGTGA<br>AATTCAATTGGTACGTGGATGGGGTC<br>GAAGTGCACAACGCCAAGACCAAGC<br>CTAGGGAAGAACAGTACAACTCTAC<br>GTACCGGGTGGTGTCCGTGCTGACCG<br>TGCTGCACCAGGACTGGCTGAACGG<br>AAAGGAGTACAAGTGCAAAGTGTCA<br>AACAAGGCTCTCCCTGCCCCTATCGA<br>AAAGACCATCAGCAAGGCCAAGGGT<br>CAACCTAGGGAGCCCCAGGTCTATA<br>CTTTGCCGCCTAGCCGGGAAGAAAT<br>GACTAAGAACCAAGTGTCCCTGACTT<br>GCCTTGTCAAGGGCTTTTATCCGTCC<br>GACATCGCCGTGGAGTGGGAGTCCA<br>ACGGACAACCGGAGAACAACTACAA<br>GACCACCCCACCGGTGCTCGATTCCG<br>ATGGCTCCTTCTTCCTGTACTCCAAG<br>CTGACTGTGGACAAGTCAAGATGGC<br>AGCAGGGAAACGTGTTCTCCTGCTCC<br>GTGATGCACGAAGCGCTGCACAACC<br>ATTACACCCAGAAATCACTGTCACTT<br>TCGCCGGGAAAA | | |
| SEQ ID<br>1739 | CAGGTGCAGCTGGTGCAGTCTGGGG<br>GAGGCTTGGTACAGCCAGGGCGGTC<br>CCTGAGACTCTCCTGTACAGCTTCTG<br>GATTCACCTTTGGTGATTATGCTATG<br>AGCTGGTTCCGCCAGGCTCCAGGGA<br>AGGGGCTGGAGTGGGTAGGTTTCATT<br>AGAAGCAAAGCTTATGGTGGACAA<br>CAGAATACGCCGCGTCTGTGAAAGG<br>CAGATTCACCATCTCAAGAGATGATT<br>CCAAAAGCATCGCCTATCTGCAAATG<br>AACAGCCTGAAAACCGAGGACACAG<br>CCGTGTATTACTGTACTAGAGGGGGG<br>ACTATGGTTCGGGGTTTCGGATTTAA<br>CTACTGGGGCCAGGGAACCCTGGTC<br>ACCGTCCTCAGCATCCACCAAGGG<br>GCCTTCCGTGTTCCCCCTGGCCCCTT<br>CATCCAAGTCGACCTCTGGTGGAACC<br>GCCGCACTCGGTTGCCTGGTCAAAGA<br>CTACTTCCCCGAGCCCGTGACTGTCT<br>CGTGGAACTCGGGCGCCCTCACATCC<br>GGAGTGCATACCTTTCCCGCCGTGTT<br>GCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA | SEQ ID<br>1847 | GAAACGACACTCACGCAGTCTCCA<br>GACACCCTGTCTGTGTCTCCAGGGG<br>GGAAGAGCCACCCTCTCCTGTAGG<br>GCCAGTCAGAGCATTGGGAGCAAT<br>TTAGCCTGGTACCAACAGAAACCT<br>GGCCAGTCTCCCAGGCTCCTCATCT<br>ATGATGCATCCACCAGGGCCACGG<br>GAATCCCAGCCAGGTTCAGTGGCA<br>GTGGGTCTGGGACAGAATTCACTC<br>TCACCATCAGCAGCCTGGAGTCTG<br>AAGATTTTGTACTTTATTACTGTCA<br>GCAGCATGGTAATGGCCCACCTTT<br>CGGCCAAGGGACACGACTGGAGAT<br>TAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | GGGAGCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | | |
| SEQ ID<br>1740 | CAGGTGCAGCTACAGCAGTGGGGCG<br>CAGGACTGTTGAAGCCTTCGGAGAC<br>CCTGTCCCTCACCTGCGCTGTCTATG<br>GTGGGTCCTTCAGTGGTTACTACTGG<br>AGCTGGATCCGCCAGCCCCCAGGGA<br>AGGGGCTGGAGTGGATTGGGGAAAT<br>CAATCATAGTGGAAGCACCAACTAC<br>AACCCGTCCCTCAAGAGTCGAGTCAC<br>CATATCAGTAGACACGTCCAAGAAC<br>CAGTTCTCCCTGAAGCTGAGCTCTGT<br>GACCGCCGCGGACACGGCTGTGTATT<br>ACTGTGCGAGAGCCCGGCGGGCTAT<br>GATAGGGCCGCTTCCGCGACTTGTCG<br>GGTACTTCGATCTCTGGGGCCGTGGA<br>ACCCTGGTCACCGTCTCCTCAGCATC<br>CACCAAGGGGCCTTCCGTGTTCCCCC<br>TGGCCCCTTCATCCAAGTCGACCTCT<br>GGTGAACCGCCGCACTCGGTTGCCT<br>GGTCAAAGACTACTTCCCCGAGCCCG<br>TGACTGTCTCGTGGAACTCGGGCGCC<br>CTCACATCCGGAGTGCATACCTTTCC<br>CGCCGTGTTGCAGTCCAGCGGCCTGT<br>ACAGCCTGAGCTCCGTCGTGACAGTG<br>CCGTCCTCCTCCCTTGGAACCCAGAC<br>CTATATCTGCAACGTCAATCACAAGC<br>CCTCCAACACCAAAGTGGACAAGAA<br>GGTCGAACCCAAGTCCTGCGACAAG<br>ACTCACACCTGTCCGCCTTGTCCAGC<br>CCCTGAGCTGCTGGGTGGTCCGTCCG<br>TGTTCCTCTTCCCGCCCAAGCCGAAG<br>GACACTCTGATGATTTCACGCACCCC<br>GGAAGTCACTTGCGTGGTCGTGGAC<br>GTGTCGCACGAAGATCCCGAAGTGA<br>AATTCAATTGGTACGTGGATGGGGTC<br>GAAGTGCACAACGCCAAGACCAAGC<br>CTAGGGAAGAACAGTACAACTCTAC<br>GTACCGGGTGGTGTCCGTGCTGACCG<br>TGCTGCACCAGGACTGGCTGAACGG<br>AAAGGAGTACAAGTGCAAAGTGTCA<br>AACAAGGCTCTCCCTGCCCCTATCGA<br>AAAGACCATCAGCAAGGCCAAGGGT<br>CAACCTAGGGAGCCCCAGGTCTATA<br>CTTTGCCGCCTAGCCGGGAAGAAAT<br>GACTAAGAACCAAGTGTCCCTGACTT<br>GCCTTGTCAAGGGCTTTTATCCGTCC<br>GACATCGCCGTGGAGTGGGAGTCCA<br>ACGGACAACCGGAGAACAACTACAA<br>GACCACCCCACCGGTGCTCGATTCCG<br>ATGGCTCCTTCTTCCTGTACTCCAAG<br>CTGACTGTGGACAAGTCAAGATGGC<br>AGCAGGGAAACGTGTTCTCCTGCTCC<br>GTGATGCACGAAGCGCTGCACAACC<br>ATTACACCCAGAAATCACTGTCACTT<br>TCGCCGGGAAAA | SEQ ID<br>1848 | GATGTTGTGATGACTCAGTCTCCAG<br>CCACCCTGTCTTTGTCTCCAGGGGA<br>AAGAGCCACCCTCTCCTGCAGGGC<br>CAGTCAGAGTGTCGGTAACTCCTT<br>AGCCTGGTACCAGCAGAAGCCTGG<br>CCAGGCTCCCCGGCTCCTCATCTAT<br>GATGCATCCAACAGGGCCACTGGC<br>ATCCCAGCCCCGGTTCAGTGGCAGT<br>GGGTCTGGGACAGACTTCACTCTC<br>ACCATCACCAGCCTAGAGCCTGAA<br>GATTTTGCAATTTATTACTGTCAAC<br>AACGTGGCACCTGGCCTCCCCTCA<br>CTTTCGGCGGAGGGACCAAGCTGG<br>AGATCAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |
| SEQ ID<br>1741 | CAGGTGCAGCTACAGCAGTGGGGCG<br>CAGGACTGTTGAAGCCTTCGGAGAC<br>CCTGTCCCTCACCTGCGCTGTCTATG<br>GTGGGTCCTTCAGTGGTTACTACTGG<br>AGCTGGATCCGCCAGCCCCCAGGGA<br>AGGGGCTGGAGTGGATTGGGGAAAT | SEQ ID<br>1849 | GATGTTGTGATGACTCAGTCTCCAT<br>CCTCCCTGTCTGCATCTGTAGGAGA<br>CACAGTCACCATCACTTGCCGGGC<br>CAGTCAGAGTATAACTAACTGGTT<br>GGCCTGGTATCAGCAGAAACCAGG<br>GAAAGCCCCCAAGCGCCTGATCTA |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CAATCATAGTGGAAGCACCAACTAC<br>AACCCGTCCCTCAAGAGTCGAGTCAC<br>CATATCAGTAGACACGTCCAAGAAC<br>CAGTTCTCCCTGAAGCTGAGCTCTGT<br>GACCGCCGCGGACACGGCTGTGTATT<br>ACTGTGCGAGAGGCCGCCCCGCCCC<br>ATCCTGGGTTAAAACCCGTAACTGGT<br>TCGACCCCTGGGGCCAGGGAACCCT<br>GGTCACCGTCTCCTCAGCATCCACCA<br>AGGGGCCTTCCGTGTTCCCCCTGGCC<br>CCTTCATCCAAGTCGACCTCTGGTGG<br>AACCGCCGCACTCGGTTGCCTGGTCA<br>AAGACTACTTCCCCGAGCCCGTGACT<br>GTCTCGTGGAACTCGGGCGCCCTCAC<br>ATCCGGAGTGCATACCTTTCCCGCCG<br>TGTTGCAGTCCAGCGGCCTGTACAGC<br>CTGAGCTCCGTCGTGACAGTGCCGTC<br>CTCCTCCCTTGGAACCCAGACCTATA<br>TCTGCAACGTCAATCACAAGCCCTCC<br>AACACCAAAGTGGACAAGAAGGTCG<br>AACCCAAGTCCTGCGACAAGACTCA<br>CACCTGTCCGCCTTGTCCAGCCCCTG<br>AGCTGCTGGGTGGTCCGTCCGTGTTC<br>CTCTTCCCGCCCAAGCCGAAGGACAC<br>TCTGATGATTTCACGCACCCCGGAAG<br>TCACTTGCGTGGTCGTGGACGTGTCG<br>CACGAAGATCCCGAAGTGAAATTCA<br>ATTGGTACGTGGATGGGGTCGAAGT<br>GCACAACGCCAAGACCAAGCCTAGG<br>GAAGAACAGTACAACTCTACGTACC<br>GGGTGGTGTCCGTGCTGACCGTGCTG<br>CACCAGGACTGGCTGAACGGAAAGG<br>AGTACAAGTGCAAAGTGTCAAACAA<br>GGCTCTCCCTGCCCCTATCGAAAAGA<br>CCATCAGCAAGGCCAAGGGTCAACC<br>TAGGGAGCCCCAGGTCTATACTTTGC<br>CGCCTAGCCGGGAAGAAATGACTAA<br>GAACCAAGTGTCCCTGACTTGCCTTG<br>TCAAGGGCTTTTATCCGTCCGACATC<br>GCCGTGGAGTGGGAGTCCAACGGAC<br>AACGGAGAACAACTACAAGACCAC<br>CCCACCGGTGCTCGATTCCGATGGCT<br>CCTTCTTCCTGTACTCCAAGCTGACT<br>GTGGACAAGTCAAGATGGCAGCAGG<br>GAAACGTGTTCTCCTGCTCCGTGATG<br>CACGAAGCGCTGCACAACCATTACA<br>CCCAGAAATCACTGTCACTTTCGCCG<br>GGAAAA | | TGGTGCGTCCAGTTTGCAGAGTGG<br>GGTCCCATCAAGGTTCAGCGGCAG<br>TGGATCTGGGACAGAATTCACTCT<br>CACAATCAGCAGCCTGCAGCCTGA<br>AGATTTTGCAACTTATTACTGTCAA<br>CAGTATACTAATTACCCTCGTACGT<br>TCGGCCAAGGGACCAAGCTGGAGA<br>TCAAACGTACTGTGGCTGCTCCCTC<br>CGTGTTCATTTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |
| SEQ ID<br>1742 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCAACAGTGCT<br>GCTTGGAACTGGATCAGGCAGTCCCC<br>ATCGAGAGGCCTTGAGTGGCTGGGA<br>AGGACATACACAGGTCCAAGTGGT<br>ATAATGATTATGCAGTATCTGTGAAA<br>AGTCGAATAACCATCAACCCAGACA<br>CATCCAAGAACCAGTTCTCCCTGCAG<br>CTGAACTCTGTGACTCCCGAGGACAC<br>GGCTGTGTATTACTGTGCAAGAGAG<br>GCTAGCAGTGGCTGGAACTGGGGCC<br>AGGGAACCCTGGTCACCGTCTCCTCA<br>GCATCCACCAAGGGGCCTTCCGTGTT<br>CCCCCTGGCCCCTTCATCCAAGTCGA<br>CCTCTGGTGGAACCGCCGCACTCGGT<br>TGCCTGGTCAAAGACTACTTCCCCGA<br>GCCCGTGACTGTCTCGTGGAACTCGG<br>GCGCCCTCACATCCGGAGTGCATACC<br>TTTCCCGCCGTGTTGCAGTCCAGCGG<br>CCTGTACAGCCTGAGCTCCGTCGTGA<br>CAGTGCCGTCCTCCTCCCTTGGAACC<br>CAGACCTATATCTGCAACGTCAATCA | SEQ ID<br>1850 | GACATCCAGATGACCCAGTCTCCTT<br>CCACCCTGTCTGCATCTGTAGGAG<br>ACAGAGTCACCATCACTTGTCGGG<br>CCAGGCAGAGCATCAGTAACCGGT<br>TGGCCTGGTATCAGCAGAAACCAG<br>GGAGAGCCCCTAATGTCCTGATCT<br>ATAAGGCGTCTACTTTAGCAAATG<br>GGGTCCCATCAAGGTTCAGCGGCA<br>GTGGATCTGGGACAGAATTCACTC<br>TCACCATCAGCAGCCTGCAGCCTG<br>ATGACTTTGCAACTTATTACTGCCA<br>ACAGTATCAAAGTTACTGGACGTT<br>CGGCCCAGGGACCAAGGTGGAAAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CAAGCCCTCCAACACCAAAGTGGAC<br>AAGAAGGTCGAACCCAAGTCCTGCG<br>ACAAGACTCACACCTGTCCGCCTTGT<br>CCAGCCCCTGAGCTGCTGGGTGGTCC<br>GTCCGTGTTCCTCTTCCCGCCCAAGC<br>CGAAGGACACTCTGATGATTTCACGC<br>ACCCCGGAAGTCACTTGCGTGGTCGT<br>GGACGTGTCGCACGAAGATCCCGAA<br>GTGAAATTCAATTGGTACGTGGATGG<br>GGTCGAAGTGCACAACGCCAAGACC<br>AAGCCTAGGGAAGAACAGTACAACT<br>CTACGTACCGGGTGGTGTCCGTGCTG<br>ACCGTGCTGCACCAGGACTGGCTGA<br>ACGGAAAGGAGTACAAGTGCAAAGT<br>GTCAAACAAGGCTCTCCCTGCCCCTA<br>TCGAAAAGACCATCAGCAAGGCCAA<br>GGGTCAACCTAGGGAGCCCCAGGTC<br>TATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | GTGACCCACCAGGGCCTGAGCAGC<br>CCAGTGACGAAGTCCTTCAACCGG<br>GGAGAATGC |
| SEQ ID<br>1743 | CAGGTGCAGCTGCAGGAGTCCGGTC<br>CAGGACTGGTGAAGCCCTCGCAGAC<br>CCTCTCACTCACCTGTGCCATCTCCG<br>GGGACAGTGTCTCTAGCAACAATGCT<br>GCTTGGAACTGGATCAGGCAGTCCCC<br>ATCGAGAGGCCTTGAGTGGCTGGGA<br>AGGACATTCTACAGGTCCAAGTGGT<br>ATAATGACTATGCAGTTTCTGTGAAA<br>AGTCGACTAACCGTCAACCCAGACA<br>CATCCAAGAACCAGTTCTCCCTGCGG<br>TTGAACTCTGTGAGTCCCGAGGACAC<br>GGCTGTGTATTACTGTGCAAGAGGG<br>GGAAGATATACCAAGGGAGGGTACT<br>TTGACGACTGGGGCCAGGGAACCCT<br>GGTGACCGTCTCCTCAGCATCCACCA<br>AGGGGCCTTCCGTGTTCCCCCTGGCC<br>CCTTCATCCAAGTCGACCTCTGGTGG<br>AACCGCCGCACTCGGTTGCCTGGTCA<br>AAGACTACTTCCCCGAGCCCGTGACT<br>GTCTCGTGGAACTCGGGCGCCCTCAC<br>ATCCGGAGTGCATACCTTTCCCGCCG<br>TGTTGCAGTCCAGCGGCCTGTACAGC<br>CTGAGCTCCGTCGTGACAGTGCCGTC<br>CTCCTCCCTTGGAACCCAGACCTATA<br>TCTGCAACGTCAATCACAAGCCCTCC<br>AACACCAAAGTGGACAAGAAGGTCG<br>AACCCAAGTCCTGCGACAAGACTCA<br>CACCTGTCCGCCTTGTCCAGCCCCTG<br>AGCTGCTGGGTGGTCCGTCCGTGTTC<br>CTCTTCCCGCCCAAGCCGAAGGACAC<br>TCTGATGATTTCACGCACCCCGGAAG<br>TCACTTGCGTGGTCGTGGACGTGTCG<br>CACGAAGATCCCGAAGTGAAATTCA<br>ATTGGTACGTGGATGGGGTCGAAGT<br>GCACAACGCCAAGACCAAGCCTAGG<br>GAAGAACAGTACAACTCTACGTACC<br>GGGTGGTGTCCGTGCTGACCGTGCTG<br>CACCAGGACTGGCTGAACGGAAAGG<br>AGTACAAGTGCAAAGTGTCAAACAA<br>GGCTCTCCCTGCCCCTATCGAAAAGA<br>CCATCAGCAAGGCCAAGGGTCAACC<br>TAGGGAGCCCCAGGTCTATACTTTGC<br>CGCCTAGCCGGGAAGAAATGACTAA<br>GAACCAAGTGTCCCTGACTTGCCTTG<br>TCAAGGGCTTTTATCCGTCCGACATC | SEQ ID<br>1851 | GACATCCAGTTGACCCAGTCTCCA<br>GCCACCCTGTCTTTGTCTCCAGGGG<br>AAAGAGCCACCCTCTCCTGCAAGG<br>CCAGTCAGAGTGTTAGTAGCTACTT<br>AGCCTGGTACCAACAGAAACTTGG<br>CCAGGCTCCCAGGCTCCTCATCTAT<br>GATGCATCCAACAGGGCCACTGGC<br>ATCCCAGCCAGGTTCAGTGCCAGT<br>GGGTCTGGGACAGACTTCACTCTC<br>ACCATCAGCAGCCTGCAGCCTGAA<br>GATGTTGCAACTTATTACTGTCAAA<br>AGTATAACAGTCCCCCTCGGACGT<br>TCGGCCAGGGGACCAAGGTGGAAA<br>TCAAACGTACTGTGGCTGCTCCCTC<br>CGTGTTCATTTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GCCGTGGAGTGGGAGTCCAACGGAC AACCGGAGAACAACTACAAGACCAC CCCACCGGTGCTCGATTCCGATGGCT CCTTCTTCCTGTACTCCAAGCTGACT GTGGACAAGTCAAGATGGCAGCAGG GAAACGTGTTCTCCTGCTCCGTGATG CACGAAGCGCTGCACAACCATTACA CCCAGAAATCACTGTCACTTTCGCCG GGAAAA | | |
| SEQ ID 1744 | CAGGTCACCTTGAAGGAGTCTGGTCC TACGCTGGTGAAACCCACACAGACC CTCACGCTGACCTGCACCTTCTCTGG GTTCTCACTCAGCACTAGTGGAGTGG GTGTGGGCTGGATCCGTCAGCCCCCA GGAAAGGCCCTGGAGTGGCTTGCAC TCATTTATTGGGATGATGATAAGCGC TACAGCCCATCTCTGAAGAGCAGGCT CACCATCACCAAGGACACCTCCAAA AACCAGGTGGTCCTTACAATGACCA ACATGGACCCTGTGGACACAGCCAC ATATTACTGTGCACACAGATTGGATA GCAGTGGCCGTGGTGGTTACTTTGAC TACTGGGGCCAGGGCACCCTGGTCA CCGTCTCCTCAGCATCCACCAAGGGG CCTTCCGTGTTCCCCCTGGCCCCTTC ATCCAAGTCGACCTCTGGTGGAACCG CCGCACTCGGTTGCCTGGTCAAAGAC TACTTCCCCGAGCCCGTGACTGTCTC GTGGAACTCGGGCGCCCTCACATCCG GAGTGCATACCTTTCCCGCCGTGTTG CAGTCCAGCGGCCTGTACAGCCTGA GCTCCGTCGTGACAGTGCCGTCCTCC TCCCTTGGAACCCAGACCTATATCTG CAACGTCAATCACAAGCCCTCCAAC ACCAAAGTGGACAAGAAGGTCGAAC CCAAGTCCTGCGACAAGACTCACAC CTGTCCGCCTTGTCCAGCCCCTGAGC TGCTGGGTGGTCCGTCCGTGTTCCTC TTCCCGCCCAAGCCGAAGGACACTCT GATGATTTCACGCACCCCGGAAGTCA CTTGCGTGGTCGTGGACGTGTCGCAC GAAGATCCCGAAGTGAAATTCAATT GGTACGTGGATGGGGTCGAAGTGCA CAACGCCAAGACCAAGCCTAGGGAA GAACAGTACAACTCTACGTACCGGG TGGTGTCCGTGCTGACCGTGCTGCAC CAGGACTGGCTGAACGGAAAGGAGT ACAAGTGCAAAGTGTCAAACAAGGC TCTCCCTGCCCCTATCGAAAAGACCA TCAGCAAGGCCAAGGGTCAACCTAG GGAGCCCCAGGTCTATACTTTGCCGC CTAGCCGGGAAGAAATGACTAAGAA CCAAGTGTCCCTGACTTGCCTTGTCA AGGGCTTTTATCCGTCCGACATCGCC GTGGAGTGGGAGTCCAACGGACAAC CGGAGAACAACTACAAGACCACCCC ACCGGTGCTCGATTCCGATGGCTCCT TCTTCCTGTACTCCAAGCTGACTGTG GACAAGTCAAGATGGCAGCAGGGAA ACGTGTTCTCCTGCTCCGTGATGCAC GAAGCGCTGCACAACCATTACACCC AGAAATCACTGTCACTTTCGCCGGGA AAA | SEQ ID 1852 | GAAACGACACTCACGCAGTCTCCA GGCACCCTGTCTTTGTCTCCAGGGG AAAGGGTCAGCCTTTCCTGCAGGG CCAGTCAGAATGTTTACAGCAATTT CTTAGCCTGGTATCAACAGAGACC TGGCCAGGCTCCCAGTCTCCTCATC TATGGTGCCTCCAGCAGGGCCGCT GGCGTCCCAGACAGGTTCAGTGGC AGTGGGTCTGGGACAGACTTCGCT CTCACCATCAGCAGAGTGGAGCCT GAAGATTTTGCAGTCTATTACTGTC AACAATATGGAACCTCACCGATCA CCTTCGGCCAAGGGACACGACTGG AGATTAAACGTACTGTGGCTGCTC CCTCCGTGTTCATTTTTCCTCCGTC GGACGAACAGCTGAAGTCCGGAAC CGCGTCCGTGGTCTGTCTCCTGAAC AACTTCTATCCGCGCGAGGCGAAA GTGCAGTGGAAGGTCGACAACGCA CTGCAGTCGGGAAACTCCCAGGAA TCGGTGACCGAGCAGGACTCGAAG GACTCAACCTACTCATTGTCCTCCA CCCTCACCCTGAGCAAGGCCGATT ACGAGAAGCATAAGGTCTACGCCT GCGAAGTGACCCACCAGGGCCTGA GCAGCCCAGTGACGAAGTCCTTCA ACCGGGGAGAATGC |
| SEQ ID 1745 | GAGGTGCAGCTGGTGGAGTCTGGGG GAGGCGTGGTCCAGCCTGGGAGGTC CCTGAGACTCTCCTGTACAGCCTCTG GATTCACCTTCAGTAGCTATGGCATG CACTGGGTCCGCCAGGCTCCAGGCA AGGGGCTGGAGTGGGTGGCAGTTAT ATCATATGATGGAAGTAATAAATACT ATGCAGACTCCGTGAAGGGCCGATT CACCATCTCCAGAGACAATTCCAAG AACACGCTGTATCTGCAAATGAACA | SEQ ID 1853 | GAAATTGTGCTGACTCAGTCTCCAC GCTCCTCACCCGTCACCCTTGGACA GCCGGCCTCCATCTCCTGTAGGTCT AGTCAAAGTCTCGAACACGGTGAT GGAAACACGTACTTGAGTTGGCTT CAGCAGAGGCCAGGCCAGCCTCCA AGACTCCTGATTTATAAGGTTTCTA ACCGGTTGTCTGGGGTCCCAGACA GATTCAGTGGCAGTGGGGCAGGGA CTGATTTCACACTGAAAATCAGCA |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GCCTGAGAGCTGAGGACACGGCTGT<br>GTATTACTGTGCGAAAGAGTTGGTGG<br>GTACCAGCTCTCCTTATTACTACTAC<br>TACTACGGTATGGACGTCTGGGGCCA<br>AGGGACAATGGTCACCGTCTCTTCAG<br>CATCCACCAAGGGGCCTTCCGTGTTC<br>CCCCTGGCCCCTTCATCCAAGTCGAC<br>CTCTGGTGGAACCGCCGCACTCGGTT<br>GCCTGGTCAAAGACTACTTCCCCGAG<br>CCCGTGACTGTCTCGTGGAACTCGGG<br>CGCCCTCACATCCGGAGTGCATACCT<br>TTCCCGCCGTGTTGCAGTCCAGCGGC<br>CTGTACAGCCTGAGCTCCGTCGTGAC<br>AGTGCCGTCCTCCTCCCTTGGAACCC<br>AGACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGTC<br>CAGCCCCTGAGCTGCTGGGTGGTCCG<br>TCCGTGTTCCTCTTCCCGCCCAAGCC<br>GAAGGACACTCTGATGATTTCACGCA<br>CCCCGGAAGTCACTTGCGTGGTCGTG<br>GACGTGTCGCACGAAGATCCCGAAG<br>TGAAATTCAATTGGTACGTGGATGGG<br>GTCGAAGTGCACAACGCCAAGACCA<br>AGCCTAGGGAAGAACAGTACAACTC<br>TACGTACCGGGTGGTGTCCGTGCTGA<br>CCGTGCTGCACCAGGACTGGCTGAA<br>CGGAAAGGAGTACAAGTGCAAAGTG<br>TCAAACAAGGCTCTCCCTGCCCCTAT<br>CGAAAAGACCATCAGCAAGGCCAAG<br>GGTCAACCTAGGGAGCCCCAGGTCT<br>ATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | GGGTGGAAGCTGAGGATGTCGGGG<br>TTTATTACTGCATGCAAGGTATATA<br>CTGGCCTCGAACCTTCGGCCAAGG<br>GACACGACTGGAGATTAAACGTAC<br>TGTGGCTGCTCCCTCCGTGTTCATT<br>TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |
| SEQ ID<br>1746 | CAGCTGCAGCTGCAGGAGTCGGGGG<br>GAGGCTTGGTCCAGCCTGGGGGGTC<br>CCTGAGACTCTCCTGTGCAGCCTCTG<br>GATTCACCGTCAGTAGCAACTACATG<br>AGCTGGGTCCGCCAGGCTCCAGGGA<br>AGGGGCTGGAGTGGGTCTCAGTTATT<br>TATAGCGGTGGTAGCACATACTACGC<br>AGACTCCGTGAAGGGCAGATTCACC<br>ATCTCCAGAGACAATTCCAAGAACA<br>CGCTGTATCTTCAAATGAACAGCCTG<br>AGAGCCGAGGACACGGCTGTGTATT<br>ACTGTGCGAGAGACTATTACTATGGT<br>TCGGGGAGTTCTCCCTGGGGCCAGG<br>GAACCCTGGTCACCGTCTCCTCAGCA<br>TCCACCAAGGGGCCTTCCGTGTTCCC<br>CCTGGCCCCTTCATCCAAGTCGACCT<br>CTGGTGGAACCGCCGCACTCGGTTGC<br>CTGGTCAAAGACTACTTCCCCGAGCC<br>CGTGACTGTCTCGTGGAACTCGGGCG<br>CCCTCACATCCGGAGTGCATACCTTT<br>CCCGCCGTGTTGCAGTCCAGCGGCTC<br>GTACAGCCTGAGCTCCGTCGTGACAG<br>TGCCGTCCTCCTCCCTTGGAACCCAG<br>ACCTATATCTGCAACGTCAATCACAA<br>GCCCTCCAACACCAAAGTGGACAAG<br>AAGGTCGAACCCAAGTCCTGCGACA<br>AGACTCACACCTGTCCGCCTTGTCCA<br>GCCCCTGAGCTGCTGGGTGGTCCGTC<br>CGTGTTCCTCTTCCCGCCCAAGCCGA<br>AGGACACTCTGATGATTTCACGCACC | SEQ ID<br>1854 | GAAACGACACTCACGCAGTCTCCA<br>GTCACCCTGTCTTTGTCTCCAGGGG<br>ACAGAGCCACCCTCTCTTGCAGGG<br>CCAGTCAGAGTGTTAGCAGCACCT<br>CCTTAGCCTGGTACCAGCACAAAC<br>CTGGCCAGGCTCCCAGGCTCCTCAT<br>CTATGGTGCATCCAGGAGGGCCAC<br>TGGCATCCCAGACAGGTTCAGTGG<br>CAGTGGGTCTGGGACAGACTTCAC<br>TCTCACCATCAACAGACTGGAGCC<br>TGAAGATTTTGCAGTGTATTACTGT<br>CAGCACTATGGTAGTTCACCTCCA<br>ATCACCTTCGGCCAAGGGACACGA<br>CTGGAGATTAAACGTACTGTGGCT<br>GCTCCCTCCGTGTTCATTTTTCCTC<br>CGTCGGACGAACAGCTGAAGTCCG<br>GAACCGCGTCCGTGGTCTGTCTCCT<br>GAACAACTTCTATCCGCGCGAGGC<br>GAAAGTGCAGTGGAAGGTCGACAA<br>CGCACTGCAGTCGGGAAACTCCCA<br>GGAATCGGTGACCGAGCAGGACTC<br>GAAGGACTCAACCTACTCATTGTC<br>CTCCACCCTCACCCTGAGCAAGGC<br>CGATTACGAGAAGCATAAGGTCTA<br>CGCCTGCGAAGTGACCCACCAGGG<br>CCTGAGCAGCCCAGTGACGAAGTC<br>CTTCAACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCGGAAGTCACTTGCGTGGTCGTGGA<br>CGTGTCGCACGAAGATCCCGAAGTG<br>AAATTCAATTGGTACGTGGATGGGGT<br>CGAAGTGCACAACGCCAAGACCAAG<br>CCTAGGGAAGAACAGTACAACTCTA<br>CGTACCGGGTGGTGTCCGTGCTGACC<br>GTGCTGCACCAGGACTGGCTGAACG<br>GAAAGGAGTACAAGTGCAAAGTGTC<br>AAACAAGGCTCTCCCTGCCCCTATCG<br>AAAAGACCATCAGCAAGGCCAAGGG<br>TCAACCTAGGGAGCCCCAGGTCTATA<br>CTTTGCCGCCTAGCCGGGAAGAAAT<br>GACTAAGAACCAAGTGTCCCTGACTT<br>GCCTTGTCAAGGGCTTTTATCCGTCC<br>GACATCGCCGTGGAGTGGGAGTCCA<br>ACGGACAACCGGAGAACAACTACAA<br>GACCACCCCACCGGTGCTCGATTCCG<br>ATGGCTCCTTCTTCCTGTACTCCAAG<br>CTGACTGTGGACAAGTCAAGATGGC<br>AGCAGGGAAACGTGTTCTCCTGCTCC<br>GTGATGCACGAAGCGCTGCACAACC<br>ATTACACCCAGAAATCACTGTCACTT<br>TCGCCGGGAAAA | | |
| SEQ ID<br>1747 | CAGGTGCAGCTACAGCAGTGGGGCG<br>CAGGACTGTTGAAGCCTTCGGAGAC<br>CCTGTCCCTCACCTGCGCTGTCTATG<br>GTGGGTCCTTCAGTGGTTACTACTGG<br>AGCTGGATCCGCCAGCCCCCAGGGA<br>AGGGGCTGGAGTGGATTGGGGAAAT<br>CAATCATAGTGGAAGCACCAACTAC<br>AACCCGTCCCTCAAGAGTCGAGTCAC<br>CATATCAGTAGACACGTCCAAGAAC<br>CAGTTCTCCCTGAAGCTGAGCTCTGT<br>GACCGCCGCGGACACGGCTGTGTATT<br>ACTGTGCGAGAGGCCGGCCATATTGT<br>AGTAGTACCAGCTGCTACCCAGAGT<br>GGTTCGACCCCTGGGGCCAGGGAAC<br>CCTGGTCACCGTCTCCTCAGCATCCA<br>CCAAGGGGCCTTCCGTGTTCCCCCTG<br>GCCCCTTCATCCAAGTCGACCTCTGG<br>TGGAACCGCCGCACTCGGTTGCCTGG<br>TCAAAGACTACTTCCCCGAGCCCGTG<br>ACTGTCTCGTGGAACTCGGGCGCCCT<br>CACATCCGGAGTGCATACCTTTCCCG<br>CCGTGTTGCAGTCCAGCGGCCTGTAC<br>AGCCTGAGCTCCGTCGTGACAGTGCC<br>GTCCTCCTCCCTTGGAACCCAGACCT<br>ATATCTGCAACGTCAATCACAAGCCC<br>TCCAACACCAAAGTGGACAAGAAGG<br>TCGAACCCAAGTCCTGCGACAAGAC<br>TCACACCTGTCCGCCTTGTCCAGCCC<br>CTGAGCTGCTGGGTGGTCCGTCCGTG<br>TTCCTCTTCCCGCCCAAGCCGAAGGA<br>CACTCTGATGATTTCACGCACCCCGG<br>AAGTCACTTGCGTGGTCGTGGACGTG<br>TCGCACGAAGATCCCGAAGTGAAAT<br>TCAATTGGTACGTGGATGGGGTCGA<br>AGTGCACAACGCCAAGACCAAGCCT<br>AGGGAAGAACAGTACAACTCTACGT<br>ACCGGGTGGTGTCCGTGCTGACCGTG<br>CTGCACCAGGACTGGCTGAACGGAA<br>AGGAGTACAAGTGCAAAGTGTCAAA<br>CAAGGCTCTCCCTGCCCCTATCGAAA<br>AGACCATCAGCAAGGCCAAGGGTCA<br>ACCTAGGGAGCCCCAGGTCTATACTT<br>TGCCGCCTAGCCGGGAAGAAATGAC<br>TAAGAACCAAGTGTCCCTGACTTGCC<br>TTGTCAAGGGCTTTTATCCGTCCGAC<br>ATCGCCGTGGAGTGGGAGTCCAACG<br>GACAACCGGAGAACAACTACAAGAC<br>CACCCCACCGGTGCTCGATTCCGATG<br>GCTCCTTCTTCCTGTACTCCAAGCTG<br>ACTGTGGACAAGTCAAGATGGCAGC | SEQ ID<br>1855 | GAAACGACACTCACGCAGTCTCCA<br>GCCACCCTGTCTGTGTCTCCAGGGG<br>AAAGAGCCACCCTCTCCTGCAGGG<br>CCAGTCAGAGTGTTGGCAGCAAAT<br>TAGCCTGGTACCAGCAGAAACCTG<br>GCCAGGCTCCCAGGCTCCTCATCTA<br>TGGTGCATCCACCAGGGCCACTGG<br>TGTCCCAGTCCGGTTCAGTGGCAGT<br>GGGTCTGGGACAGAATTCACTCTC<br>ACCATCAGCAGCCTGCAGTCTGAA<br>GATTTTGCAGTTTATTACTGTCAGC<br>AGTATAATAACTGGCCCCCGATCA<br>CCTTCGGCCAAGGGACACGACTGG<br>AGATTAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | AGGGAAACGTGTTCTCCTGCTCCGTG<br>ATGCACGAAGCGCTGCACAACCATT<br>ACACCCAGAAATCACTGTCACTTTCG<br>CCGGGAAAA | | |
| SEQ ID<br>1748 | CAGGTCACCTTGAAGGAGTCTGGGG<br>GAGGCGTGGTCCAGCCTGGGAGGTC<br>CCTGAGACTCTCCTGTGCAGCCTCTG<br>GATTCACCTTCAGTAGCTATGGCATG<br>CACTGGGTCCGCCAGGCTCCAGGCA<br>AGGGGCTGGAGTGGGTGGCAGTTAT<br>ATCATATGATGGAAGTAATAAATACT<br>ATGCAGACTCCGTGAAGGGCCGATT<br>CACCATCTCCAGAGACAATTCCAAG<br>AACACGCTGTATCTGCAAATGAACA<br>GCCTGAGAGCTGAGGACACGGCTGT<br>GTATTACTGTGCGAAATTAAGGGGTA<br>TAGATTACTATGATAGTAGTGGTTAC<br>CAACGGGGGTTTGACTACTGGGGCC<br>AGGGAACCCTGGTCACCGTCTCCTCA<br>GCATCCACCAAGGGGCCTTCCGTGTT<br>CCCCCTGGCCCCTTCATCCAAGTCGA<br>CCTCTGGTGGAACCGCCGCACTCGGT<br>TGCCTGGTCAAAGACTACTTCCCCGA<br>GCCCGTGACTGTCTCGTGGAACTCGG<br>GCGCCCTCACATCCGGAGTGCATACC<br>TTTCCCGCCGTGTTGCAGTCCAGCGG<br>CCTGTACAGCCTGAGCTCCGTCGTGA<br>CAGTGCCGTCCTCCTCCCTTGGAACC<br>CAGACCTATATCTGCAACGTCAATCA<br>CAAGCCCTCCAACACCAAAGTGGAC<br>AAGAAGGTCGAACCCAAGTCCTGCG<br>ACAAGACTCACACCTGTCCGCCTTGT<br>CCAGCCCTGAGCTGCTGGGTGGTCC<br>GTCCGTGTTCCTCTTCCCGCCCAAGC<br>CGAAGGACACTCTGATGATTTCACGC<br>ACCCCGGAAGTCACTTGCGTGGTCGT<br>GGACGTGTCGCACGAAGATCCCGAA<br>GTGAAATTCAATTGGTACGTGGATGG<br>GGTCGAAGTGCACAACGCCAAGACC<br>AAGCCTAGGGAAGAACAGTACAACT<br>CTACGTACCGGGTGGTGTCCGTGCTG<br>ACCGTGCTGCACCAGGACTGGCTGA<br>ACGGAAAGGAGTACAAGTGCAAAGT<br>GTCAAACAAGGCTCTCCCTGCCCCTA<br>TCGAAAAGACCATCAGCAAGGCCAA<br>GGGTCAACCTAGGGAGCCCCAGGTC<br>TATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | SEQ ID<br>1856 | GAAATTGTGTTGACGCAGTCTCCA<br>CTCTCCCTGCCCGTCACCCCTGGAG<br>AGCCGGCCTCCATCTCCTGCAGGTC<br>TAGTCAGAGCCTCCTGCATAGTAA<br>TGGATACAACTATTTGGATTGGTAC<br>CTGCAGAAGCCAGGGCAGTCTCCA<br>CAGCTCCTGATCTATTTGGGTTCTA<br>ATCGGGCCTCCGGGGTCCCTGACA<br>GGTTCAGTGGCAGTGGATCAGGCA<br>CAGATTTTACACTGAAAATCAGCA<br>GAGTGGAGGCTGAGGATGTTGGGG<br>TGTATTACTGCATGCAAACTCTTCA<br>AACTCCGCTCACTTTCGGCGGAGG<br>GACCAAAGTGGATATCAAACGTAC<br>TGTGGCTGCTCCCTCCGTGTTCATT<br>TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |
| SEQ ID<br>1749 | CAGGTGCAGCTGCAGGAGTCCGGCC<br>CAGGACTGGTGAAGCCTTCGGAGAC<br>CCTGTCCCTCACCTGCACTGTCTCTG<br>GTGGCTCCATCAGTAGTTACTACTGG<br>AGCTGGATCCGGCAGCCCCCAGGGA<br>AGGGACTGGAGTGGATTGGCTATAT<br>CTATTACACTGGGAGCACCAACTACA<br>ACCCCTCCCTCAAGAGCCGAGTCACC<br>ATATCAGTAGACACGTCCAAGAACC<br>AGTTCTCCCTGAAGCTGAGCTCTGTG<br>ACCACTGCGGACACGGCCGTGTATTA<br>CTGTGCGAGAGGTGGGAGGGGGGAT<br>GGGGCCGCTTTTGACATCTGGGGCCA<br>AGGGACAATGGTCACCGTCTCTTCAG<br>CATCCACCAAGGGGCCTTCCGTGTTC | SEQ ID<br>1857 | GATGTTGTGATGACTCAGTCTCCAG<br>ACTCCCTGGCTGTGTCTCTGGGCGA<br>GAGGGCCACCATCAACTGCAAGTC<br>CAGCCAGAGTGTTTTATACAGCTCC<br>AACAATAAGAACTACTTAGCTTGG<br>TACCAGCAGAAACCAGGACAGCCT<br>CCTAAGCTGCTCATTTACTGGGCAT<br>CTACCCGGGAATCCGGGTCCCTG<br>ACCGATTCAGTGGCAGCGGGTCTG<br>GGACAGATTTCACTCTCACCATCA<br>GCAGCCTGCAGGCTGAAGATGTGG<br>CAGTTTATTACTGTCAGCAATATTA<br>TAGTAGTACTCCGTACACTTTTGGC<br>CAGGGGACCAAGCTGGAGATCAAA<br>CGTACTGTGGCTGCTCCCTCCGTGT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CCCCTGGCCCCTTCATCCAAGTCGAC<br>CTCTGGTGGAACCGCCGCACTCGGTT<br>GCCTGGTCAAAGACTACTTCCCCGAG<br>CCCGTGACTGTCTCGTGGAACTCGGG<br>CGCCCTCACATCCGGAGTGCATACCT<br>TTCCCGCCGTGTTGCAGTCCAGCGGC<br>CTGTACAGCCTGAGCTCCGTCGTGAC<br>AGTGCCGTCCTCCTCCCTTGGAACCC<br>AGACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGTC<br>CAGCCCCTGAGCTGCTGGGTGGTCCG<br>TCCGTGTTCCTCTTCCCGCCCAAGCC<br>GAAGGACACTCTGATGATTTCACGCA<br>CCCCGGAAGTCACTTGCGTGGTCGTG<br>GACGTGTCGCACGAAGATCCCGAAG<br>TGAAATTCAATTGGTACGTGGATGGG<br>GTCGAAGTGCACAACGCCAAGACCA<br>AGCCTAGGGAAGAACAGTACAACTC<br>TACGTACCGGGTGGTGTCCGTGCTGA<br>CCGTGCTGCACCAGGACTGGCTGAA<br>CGGAAAGGAGTACAAGTGCAAAGTG<br>TCAAACAAGGCTCTCCCTGCCCCTAT<br>CGAAAAGACCATCAGCAAGGCCAAG<br>GGTCAACCTAGGGAGCCCCAGGTCT<br>ATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTGGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | TCATTTTTCCTCCGTCGGACGAACA<br>GCTGAAGTCCGGAACCGCGTCCGT<br>GGTCTGTCTCCTGAACAACTTCTAT<br>CCGCGCGAGGCGAAAGTGCAGTGG<br>AAGGTCGACAACGCACTGCAGTCG<br>GGAAACTCCCAGGAATCGGTGACC<br>GAGCAGGACTCGAAGGACTCAACC<br>TACTCATTGTCCTCCACCCTCACCC<br>TGAGCAAGGCCGATTACGAGAAGC<br>ATAAGGTCTACGCCTGCGAAGTGA<br>CCCACCAGGGCCTGAGCAGCCCAG<br>TGACGAAGTCCTTCAACCGGGGAG<br>AATGC |
| SEQ ID<br>1750 | CAGGTGCAGCTGGTGCAATCTGGGG<br>GAGGCGTGGTCCAGCCTGGGAGGTC<br>CCTGAGACTCTCCTGTGCAGCGTCTG<br>GATTCACCTTCAGCAGCTCTGCCATG<br>CACTGGGTCCGCCAGGCTCCAGGCA<br>AGGGACTGGAGTGGGTGGCAATGAT<br>TTGGCATGATGAGAGTAAGAAATAC<br>TATGCAGACTCCGTGAAGGGCCGATT<br>CACTATCTCCAGAGACAATTCCAAGA<br>ACACGCTGTATCTGCAAATGAACAG<br>CCTGAGAGCTGAGGACACGGCTGTG<br>TATTACTGTGCGAGACCCCCCGACGG<br>TGGTAACTCCGGTCGCTGGTACTTCG<br>ATCTCTGGGGCCGTGGCACCCTGGTC<br>ACCGTCTCCTCAGCATCCACCAAGGG<br>GCCTTCCGTGTTCCCCCTGGCCCCTT<br>CATCCAAGTCGACCTCTGGTGGAACC<br>GCCGCACTCGGTTGCCTGGTCAAAGA<br>CTACTTCCCCGAGCCCGTGACTGTCT<br>CGTGGAACTCGGGCGCCCTCACATCC<br>GGAGTGCATACCTTTCCCGCCGTGTT<br>GCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG | SEQ ID<br>1858 | GATATTGTGATGACCCACACTCCCC<br>TCTCTCTGTCCGTCACCCCTGGACA<br>GCCGGCCTCCATCTCCTGCAAGTCT<br>AGTCAGAGCCTCCTGGGTGGTGAT<br>GGAAAGACCTATTTGTATTGGTAC<br>CTGCAGAAGCCAGGCCAGCCTCCA<br>CAGCTCCTGCTCTATGAAGTTTCCA<br>ACCGATTCTCTGGAGTGCCAGATA<br>GGTTCAGTGGCAGCGGGCAGCGA<br>CAGATTTCACACTGAAAATCAGCA<br>GGGTGGAAGCTGAGGATGTCGGGG<br>TTTATTACTGCATGCAATCTACACA<br>ATTTCCGTGGACGTTCGGCCAAGG<br>GACCAAGGTGGAGATCAAACGTAC<br>TGTGGCTGCTCCCTCCGTGTTCATT<br>TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | | |
| SEQ ID 1751 | CAGATGCAGCTGGTGCAATCTGGGG<br>GAGGCTTGGTACAGCCTGGGGGGTC<br>CCTGAGACTCTCCTGTGCAGCCTCTG<br>GATTCACCTTTAGCAGCTATGCCATG<br>AGCTGGGTCCGCCAGGCTCCAGGGA<br>AGGGGCTGGAGTGGGTCTCAGCTATT<br>AGTGGTAGTGGTGGTAGCACATACT<br>ACGCAGACTCCGTGAAGGGCCGGTT<br>CACCATCTCCAGAGACAATTCCAAG<br>AACACGCTGTATCTGCAAATGAACA<br>GCCTGAGAGCCGAGGACACGGCCGT<br>ATATTACTGTGCGAAAGACAAGAAC<br>GTCCGAAAACATGACTACGGTGACC<br>ACCCCTACGGGGGGTACTTTGACTAC<br>TGGGGCCAGGGCACCCTGGTGACCG<br>TCTCCTCAGCATCCACCAAGGGGCCT<br>TCCGTGTTCCCCCTGGCCCCTTCATC<br>CAAGTCGACCTCTGGTGGAACCGCC<br>GCACTCGGTTGCCTGGTCAAAGACTA<br>CTTCCCCGAGCCCGTGACTGTCTCGT<br>GGAACTCGGGCGCCCTCACATCCGG<br>AGTGCATACCTTTCCCGCCGTGTTGC<br>AGTCCAGCGGCCTGTACAGCCTGAG<br>CTCCGTCGTGACAGTGCCGTCCTCCT<br>CCCTTGGAACCCAGACCTATATCTGC<br>AACGTCAATCACAAGCCCTCCAACA<br>CCAAAGTGGACAAGAAGGTCGAACC<br>CAAGTCCTGCGACAAGACTCACACCT<br>GTCCGCCTTGTCCAGCCCCTGAGCTG<br>CTGGGTGGTCCGTCCGTGTTCCTCTT<br>CCCGCCCAAGCCGAAGGACACTCTG<br>ATGATTTCACGCACCCCGGAAGTCAC<br>TTGCGTGGTCGTGGACGTGTCGCACG<br>AAGATCCCGAAGTGAAATTCAATTG<br>GTACGTGGATGGGGTCGAAGTGCAC<br>AACGCCAAGACCAAGCCTAGGGAAG<br>AACAGTACAACTCTACGTACCGGGT<br>GGTGTCCGTGCTGACCGTGCTGCACC<br>AGGACTGGCTGAACGGAAAGGAGTA<br>CAAGTGCAAAGTGTCAAACAAGGCT<br>CTCCCTGCCCCTATCGAAAAGACCAT<br>CAGCAAGGCCAAGGGTCAACCTAGG<br>GAGCCCCAGGTCTATACTTTGCCGCC<br>TAGCCGGGAAGAAATGACTAAGAAC<br>CAAGTGTCCCTGACTTGCCTTGTCAA<br>GGGCTTTTATCCGTCCGACATCGCCG<br>TGGAGTGGGAGTCCAACGGACAACC<br>GGAGAACAACTACAAGACCACCCCA<br>CCGGTGCTCGATTCCGATGGCTCCTT<br>CTTCCTGTACTCCAAGCTGACTGTGG<br>ACAAGTCAAGATGGCAGCAGGGAAA<br>CGTGTTCTCCTGCTCCGTGATGCACG<br>AAGCGCTGCACAACCATTACACCCA<br>GAAATCACTGTCACTTTCGCCGGGAA<br>AA | SEQ ID 1859 | GAAACGACACTCACGCAGTCTCCA<br>GGCACCCTGTCTTTGTCTGCAGGGG<br>AAAGAGCCACCCTCTCCTGCAGGG<br>CCAGTCAGAGTGTTAGCAGCAGCT<br>ACTTAGCCTGGTACCAGCAGAAAC<br>CTGGCCAGGCTCCCAGGCTCCTCAT<br>CTATGCTGCATCCTACAGGGCCACT<br>GGCATCCCAGACAGGTTCAGTGGC<br>CGTGGGTCTGGGACAGAGTTCACT<br>CTCACCATCAGCAGCCTGCAGTCT<br>GAAGATTTTGCAGTTTATTACTGTC<br>AGCAGTATAATAACTGGCCTCCCA<br>TCACCTTCGGCCAAGGGACACGAC<br>TGGAGATTAAACGTACTGTGGCTG<br>CTCCCTCCGTGTTCATTTTTCCTCC<br>GTCGGACGAACAGCTGAAGTCCGG<br>AACCGCGTCCGTGGTCTGTCTCCTG<br>AACAACTTCTATCCGCGCGAGGCG<br>AAAGTGCAGTGGAAGGTCGACAAC<br>GCACTGCAGTCGGGAAACTCCCAG<br>GAATCGGTGACCGAGCAGGACTCG<br>AAGGACTCAACCTACTCATTGTCCT<br>CCACCCTCACCCTGAGCAAGGCCG<br>ATTACGAGAAGCATAAGGTCTACG<br>CCTGCGAAGTGACCCACCAGGGCC<br>TGAGCAGCCCAGTGACGAAGTCCT<br>TCAACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| SEQ ID 1752 | GAGGTCCAGCTGGTACAGTCTGGGG CTGAGGTGAAGAAGCCTGGGGCCTC AGTGAAGGTTTCCTGCAAGGCTTCTG GATACACCTTCACTAGCTATGCTATG CATTGGGTGCGCCAGGCCCCCGGAC AAAAGGCTTGAGTGGATGGGATGGAT CAACGCTGGCAATGGTAACACAAAA TATTCACAGAAGTTCCAGGGCAGAG TCACCATTACCAGGGACACATCCGCG AGCACAGCCTACATGGAGCTGAGCA GCCTGAGATCTGAAGACACGGCTGT GTATTACTGTGCGAGAGTGGCGGGA GCTACTTCCCTATGGTACTGGGGCCA GGGCACCCTGGTCACCGTCTCCTCAG CATCCACCAAGGGGCCTTCCGTGTTC CCCCTGGCCCCTTCATCCAAGTCGAC CTCTGGTGGAACCGCCGCACTCGGTT GCCTGGTCAAAGACTACTTCCCCGAG CCCGTGACTGTCTCGTGGAACTCGGG CGCCCTCACATCCGGAGTGCATACCT TTCCCGCCGTGTTGCAGTCCAGCGGC CTGTACAGCCTGAGCTCCGTCGTGAC AGTGCCGTCCTCCTCCCTTGGAACCC AGACCTATATCTGCAACGTCAATCAC AAGCCCTCCAACACCAAAGTGGACA AGAAGGTCGAACCCAAGTCCTGCGA CAAGACTCACACCTGTCCGCCTTGTC CAGCCCCTGAGCTGCTGGGTGGTCCG TCCGTGTTCCTCTTCCCGCCCAAGCC GAAGGACACTCTGATGATTTCACGCA CCCCGGAAGTCACTTGCGTGGTCGTG GACGTGTCGCACGAAGATCCCGAAG TGAAATTCAATTGGTACGTGGATGGG GTCGAAGTGCACAACGCCAAGACCA AGCCTAGGGAAGAACAGTACAACTC TACGTACCGGGTGGTGTCCGTGCTGA CCGTGCTGCACCAGGACTGGCTGAA CGGAAAGGAGTACAAGTGCAAAGTG TCAAACAAGGCTCTCCCTGCCCCTAT CGAAAAGACCATCAGCAAGGCCAAG GTCAACCTAGGGGAGCCCCAGGTCT ATACTTTGCCGCCTAGCCGGGAAGA AATGACTAAGAACCAAGTGTCCCTG ACTTGCCTTGTCAAGGGCTTTTATCC GTCCGACATCGCCGTGGAGTGGGAG TCCAACGGACAACCGGAGAACAACT ACAAGACCACCCCACCGGTGCTCGA TTCCGATGGCTCCTTCTTCCTGTACTC CAAGCTGACTGTGGACAAGTCAAGA TGGCAGCAGGGAAACGTGTTCTCCTG CTCCGTGATGCACGAAGCGCTGCAC AACCATTACACCCAGAAATCACTGTC ACTTTCGCCGGGAAAA | SEQ ID 1860 | GATGTTGTGATGACTCAGTCTCCAG CCACCCTGTCTGTGTCTCCAGGGGA AAGAGCCACCCTCTCCTGCAGGGC CAGTCAGAGTGTTAGCAGCAACTT AGCCTGGTACCAGCAGAAACCTGG CCAGGCTCCCAGGCTCCTCATCTAT GATGCATCCACCAGGGCCACTGGT ATCCCAGCCAGGTTCAGTGGCAGT GGGTCTGGGACAGAGTTCACTCTC ACCATCAGCAGCCTGCAGTCTGAA GATTTTGCAGTTTATTACTGTCAGC ACTATAATAACTGGCCTCATACCTT CGGCCAAGGGACCAAGCTGGAGAT CAAACGTACTGTGGCTGCTCCCTCC GTGTTCATTTTTCCTCCGTCGGACG AACAGCTGAAGTCCGGAACCGCGT CCGTGGTCTGTCTCCTGAACAACTT CTATCCGCGCGAGGCGAAAGTGCA GTGGAAGGTCGACAACGCACTGCA GTCGGGAAACTCCCAGGAATCGGT GACCGAGCAGGACTCGAAGGACTC AACCTACTCATTGTCCTCCACCCTC ACCCTGAGCAAGGCCGATTACGAG AAGCATAAGGTCTACGCCTGCGAA GTGACCCACCAGGGCCTGAGCAGC CCAGTGACGAAGTCCTTCAACCGG GGAGAATGC |
| SEQ ID 1753 | CAGGTACAGCTGCAGCAGTCAGGTC CAGGACTGGTGAAGCCCTCGCAGAG CCTCTCACTCACCTGTGCCATCTCCG GGGACAGTGTCTCTAGCAACAGTGCT GCTTGGAACTGGATCAGGCAGTCCCC ATCGAGAGGCCTTGAGTGGCTGGGA AGGACATACACAGGTCCAAGTGGT ATAATGATTATGCAGTATCTGTGAAG AGTCGAATAACCATCAAACCAGACA CATCCAAGAACCAGTTCTCCTGCAG CTGAACTCTGTGACTCCCGAGGACAC GGCTGTGTATTACTGTACAAGGCTAG CTAATTCCGACGGTGTGGACGTCTGG GGCCAAGGGACAATGGTCACCGTCT CCTCAGCATCCACCAAGGGGCCTTCC GTGTTCCCCCTGGCCCCTTCATCCAA GTCGACCTCTGGTGGAACCGCCGCAC TCGGTTGCCTGGTCAAAGACTACTTC CCCGAGCCCGTGACTGTCTCGTGGAA CTCGGGCGCCCTCACATCCGGAGTGC ATACCTTTCCCGCCGTGTTGCAGTCC | SEQ ID 1861 | GAAACGACACTCACGCAGTCTCCA GGCACCCTGTCTTTGTCTCAGGGG AAAGAGCCACCCTCTCCTGCAGGG CCAGTCAGAGTGTTAGCAGCAACT CCTTAGCCTGGTACCAGCAGAAAC CTGGCCAGGCTCCCAGGCTCCTCAT CTATGGTGCATCCAGCAGGGCCTC TGGCATCCCAGACAGGTTCAATGG CAGTGGGTCTGGGACAGACTTCAC TCTCACCATCAATAGGCTGGAGCC TGAAGACTTTGCAGTGTATTACTGT CAGCAGTATGGTAACTCACAGACC TTCGGCCAAGGGACACGACTGGAG ATTAAACGTACTGTGGCTGCTCCCT CCGTGTTCATTTTTCCTCCGTCGGA CGAACAGCTGAAGTCCGGAACCGC GTCCGTGGTCTGTCTCCTGAACAAC TTCTATCCGCGCGAGGCGAAAGTG CAGTGGAAGGTCGACAACGCACTG CAGTCGGGAAACTCCCAGGAATCG GTGACCGAGCAGGACTCGAAGGAC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AGCGGCCTGTACAGCCTGAGCTCCGT<br>CGTGACAGTGCCGTCCTCCTCCCTTG<br>GAACCCAGACCTATATCTGCAACGTC<br>AATCACAAGCCCTCCAACACCAAAG<br>TGGACAAGAAGGTCGAACCCAAGTC<br>CTGCGACAAGACTCACACCTGTCCGC<br>CTTGTCCAGCCCCTGAGCTGCTGGGT<br>GGTCCGTCCGTGTTCCTCTTCCCGCC<br>CAAGCCGAAGGACACTCTGATGATTT<br>CACGCACCCCGGAAGTCACTTGCGTG<br>GTCGTGGACGTGTCGCACGAAGATC<br>CCGAAGTGAAATTCAATTGGTACGTG<br>GATGGGGTCGAAGTGCACAACGCCA<br>AGACCAAGCCTAGGGAAGAACAGTA<br>CAACTCTACGTACCGGGTGGTGTCCG<br>TGCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | TCAACCTACTCATTGTCCTCCACCC<br>TCACCCTGAGCAAGGCCGATTACG<br>AGAAGCATAAGGTCTACGCCTGCG<br>AAGTGACCCACCAGGGCCTGAGCA<br>GCCCAGTGACGAAGTCCTTCAACC<br>GGGGAGAATGC |
| SEQ ID 1754 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCGACAGTGCT<br>GTTTGGACCTGGATCAGGCAGTCCCC<br>ATCGAGAGGCCTTGAGTGGCTGGGA<br>AGGACATACTACAAGTCGAAGTGGT<br>ATAATGATTATGCAGCATCTGTGAAA<br>AGTCGAATAACCATCAACCCAGACA<br>CATCCAAGAACCAGTTCTCCCTGCAC<br>CTGAACTCTGTGACTCCCGAGGACAC<br>GGCTGTGTATTACTGTGCAAGAGGTG<br>TAACCCGGACCTTTGACTACTGGGGC<br>CAGGGGACCACGGTCACCGTCTCCTC<br>AGCATCCACCAAGGGGCCTTCCGTGT<br>TCCCCCTGGCCCCTTCATCCAAGTCG<br>ACCTCTGGTGAACCGCCGCACTCGG<br>TTGCCTGGTCAAAGACTACTTCCCCG<br>AGCCCGTGACTGTCTCGTGGAACTCG<br>GGCGCCCTCACATCCGGAGTGCATAC<br>CTTTCCCGCCGTGTTGCAGTCCAGCG<br>GCCTGTACAGCCTGAGCTCCGTCGTG<br>ACAGTGCCGTCCTCCTCCCTTGGAAC<br>CCAGACCTATATCTGCAACGTCAATC<br>ACAAGCCCTCCAACACCAAAGTGGA<br>CAAGAAGGTCGAACCCAAGTCCTGC<br>GACAAGACTCACACCTGTCCGCCTTG<br>TCCAGCCCCTGAGCTGCTGGGTGGTC<br>CGTCCGTGTTCCTCTTCCCGCCCAAG<br>CCGAAGGACACTCTGATGATTTCACG<br>CACCCCGGAAGTCACTTGCGTGGTCG<br>TGGACGTGTCGCACGAAGATCCCGA<br>AGTGAAATTCAATTGGTACGTGGATG<br>GGGTCGAAGTGCACAACGCCAAGAC<br>CAAGCCTAGGGAAGAACAGTACAAC<br>TCTACGTACCGGGTGGTGTCCGTGCT<br>GACCGTGCTGCACCAGGACTGGCTG<br>AACGGAAAGGAGTACAAGTGCAAAG<br>TGTCAAACAAGGCTCTCCCTGCCCCT<br>ATCGAAAAGACCATCAGCAAGGCCA<br>AGGGTCAACCTAGGGAGCCCCAGGT<br>CTATACTTTGCCGCCTAGCCGGGAAG | SEQ ID 1862 | GATGTTGTGATGACTCAGTCTCCAG<br>CCACCCTGTCTGTGTCTCCAGGGGA<br>AAGAGCCACCCTCTCCTGCAGGGC<br>CAGTCAGAGTGTTAGCAGCAACTT<br>AGCCTGGTACCAGCAGAAACCTGG<br>CCAGGCTCCCAGGCTCCTCATCTAT<br>GGTGCATCCACCAGGGCCACTGGT<br>ATCCCAGGCAGGTTCAGTGGCAGT<br>GGGTCTGGGACAGAGTTCACTCTC<br>ACCATCAGCAGCCTGCAGTCTGAA<br>GATTTTGCAGTTTATTACTGTCAGC<br>AGTATAATAACTGGCCCCGGACGT<br>TCGGCCAAGGGACCAAGCTGGAGA<br>TCAAACGTACTGTGGCTGCTCCCTC<br>CGTGTTCATTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>GAAGCATAAGGTCTACGCCTGCGA<br>AGTGACCCACCAGGGCCTGAGCAG<br>CCCAGTGACGAAGTCCTTCAACCG<br>GGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AAATGACTAAGAACCAAGTGTCCCT<br>GACTTGCCTTGTCAAGGGCTTTTATC<br>CGTCCGACATCGCCGTGGAGTGGGA<br>GTCCAACGGACAACCGGAGAACAAC<br>TACAAGACCACCCCACCGGTGCTCG<br>ATTCCGATGGCTCCTTCTTCCTGTACT<br>CCAAGCTGACTGTGGACAAGTCAAG<br>ATGGCAGCAGGGAAACGTGTTCTCCT<br>GCTCCGTGATGCACGAAGCGCTGCA<br>CAACCATTACACCCAGAAATCACTGT<br>CACTTTCGCCGGGAAAA | | |
| SEQ ID 1755 | CAGCTGCAGCTGCAGGAGTCGGGTC<br>CAGGACTGGTGAAGCCCTCGCAGAC<br>CCTCTCACTCACCTGTGCCATCTCCG<br>GGGACAGTGTCTCTAGCAACAGTGCT<br>GCTTGGAACTGGATCAGGCAGTCCCC<br>ATCGAGAGGCCTTGAGTGGCTGGGA<br>AGGACATACTACAGGTCCAAGTGGT<br>ATAATGATTATGCAGTATCTGTGAAA<br>AGTCGAATAACCATCAACCCAGACA<br>CATCCAAGAACCAGTTCTCCCTGCAG<br>CTGAACTCTGTGACTCCCGAGGACAC<br>GGCTGTGTATTACTGTGCAGAAGGCA<br>ATGGGCCGTTCGACCCCTGGGGCCA<br>GGGAACCCTGGTGACCGTCTCCTCAG<br>CATCCACCAAGGGGCCTTCCGTGTTC<br>CCCCTGGCCCCTTCATCCAAGTCGAC<br>CTCTGGTGGAACCGCCGCACTCGGTT<br>GCCTGGTCAAAGACTACTTCCCCGAG<br>CCCGTGACTGTCTCGTGGAACTCGGG<br>CGCCCTCACATCCGGAGTGCATACCT<br>TTCCGCCGTGTTGCAGTCCAGCGGC<br>CTGTACAGCCTGAGCTCCGTCGTGAC<br>AGTGCCGTCCTCCTCCCTTGGAACCC<br>AGACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGTC<br>CAGCCCCTGAGCTGCTGGGTGGTCCG<br>TCCGTGTTCCTCTTCCCGCCCAAGCC<br>GAAGGACACTCTGATGATTTCACGCA<br>CCCCGGAAGTCACTTGCGTGGTCGTG<br>GACGTGTCGCACGAAGATCCCGAAG<br>TGAAATTCAATTGGTACGTGGATGGG<br>GTCGAAGTGCACAACGCCAAGACCA<br>AGCCTAGGGAAGAACAGTACAACTC<br>TACGTACCGGGTGGTGTCCGTGCTGA<br>CCGTGCTGCACCAGGACTGGCTGAA<br>CGGAAAGGAGTACAAGTGCAAAGTG<br>TCAAACAAGGCTCTCCCTGCCCCTAT<br>CGAAAAGACCATCAGCAAGGCCAAG<br>GGTCAACCTAGGGAGCCCCAGGTCT<br>ATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | SEQ ID 1863 | GATGTTGTGATGACTCAGTCTCCAC<br>TCTCCCTGCCCGTCACCCTTGGACA<br>GCCGGCCTCCATCTCCTGCAGGTCT<br>AGTCAAAGCCTCGTATACAGTGAT<br>GGAAACACCTACTTGAATTGGTTTC<br>AGCAGAGGCCAGGCCAATCTCCAA<br>GGCGCCTAATTTATAAGGTTTCTAA<br>CCGGGACTCTGGGGTCCCAGACAG<br>ATTCAGCGGCAGTGGGTCAGGCAC<br>TGATTTCACACTGAAAATCAGCAG<br>GGTGGAGGCTGAGGATGTTGGGGT<br>TTATTACTGCATGCAAGGTACACAT<br>TGGCCTCGGACTTTCGGCGGAGGG<br>ACCAAGCTGGAGATCAAACGTACT<br>GTGGCTGCTCCCTCCGTGTTCATTT<br>TTCCTCCGTCGGACGAACAGCTGA<br>AGTCCGGAACCGCGTCCGTGGTCT<br>GTCTCCTGAACAACTTCTATCCGCG<br>CGAGGCGAAAGTGCAGTGGAAGGT<br>CGACAACGCACTGCAGTCGGGAAA<br>CTCCCAGGAATCGGTGACCGAGCA<br>GGACTCGAAGGACTCAACCTACTC<br>ATTGTCCTCCACCCTCACCCTGAGC<br>AAGGCCGATTACGAGAAGCATAAG<br>GTCTACGCCTGCGAAGTGACCCAC<br>CAGGGCCTGAGCAGCCCAGTGACG<br>AAGTCCTTCAACCGGGGAGAATGC |
| SEQ ID 1756 | CAGATCACCTTGAAGGAGTCTGGGG<br>GAGGCGTGGTCCAGCCTGGGAGGTC<br>CCTGAGACTCTCCTGTGTAGCCTCTG<br>GATTCACCTTCAGTACCTATCCCATG<br>CACTGGGTCCGCCAGGCTCCAGGCA<br>AGGGGCTGGAGTGGGTGGCAGTTAT<br>ATCATATGATGGACGTAATGAATACT<br>ACGCAGACTCCGTGAAGGGCCGATT<br>CACCATCTCCAGAGACAATTCCAAA | SEQ ID 1864 | GACATCCAGATGACCCAGTCTCCTT<br>CCACCCTGTCTGCATCTGTAGGAG<br>ACAGAGTCACCATCACTTGCCGGG<br>CCAGTCAGAGTATTAGTAGGTGGT<br>TGGCCTGGTATCAGCAGAAGCCAG<br>GGAAAGCCCCTAAGCTCCTGATCT<br>ATAAGGCGTCTACTATAAAAGTG<br>GGGTCCCATCAAGATTCAGCGCCA<br>GTGGATCTGGGACAGAATTCACTC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AACACGCTGTATCTGCAAATGAACA<br>GTCTGCGAGCTGAAGACACGGCTGT<br>CTATTATTGTGCGACTCGGGATACAC<br>CTTTGGTTGGGGTTTCGATATACTGG<br>GGCCAGGGCACCCTGGTCACCGTCTC<br>CTCAGCATCCACCAAGGGGCCTTCCG<br>TGTTCCCCCTGGCCCCTTCATCCAAG<br>TCGACCTCTGGTGGAACCGCCGCACT<br>CGGTTGCCTGGTCAAAGACTACTTCC<br>CCGAGCCCGTGACTGTCTCGTGGAAC<br>TCGGGCGCCCTCACATCCGGAGTGCA<br>TACCTTTCCCGCCGTGTTGCAGTCCA<br>GCGGCCTGTACAGCCTGAGCTCCGTC<br>GTGACAGTGCCGTCCTCCTCCCTTGG<br>AACCCAGACCTATATCTGCAACGTCA<br>ATCACAAGCCCTCCAACACCAAAGT<br>GGACAAGAAGGTCGAACCCAAGTCC<br>TGCGACAAGACTCACACCTGTCCGCC<br>TTGTCCAGCCCCTGAGCTGCTGGGTG<br>GTCCGTCCGTGTTCCTCTTCCCGCCC<br>AAGCCGAAGGACACTCTGATGATTTC<br>ACGCACCCCGGAAGTCACTTGCGTG<br>GTCGTGGACGTGTCGCACGAAGATC<br>CCGAAGTGAAATTCAATTGGTACGTG<br>GATGGGGTCGAAGTGCACAACGCCA<br>AGACCAAGCCTAGGGAAGAACAGTA<br>CAACTCTACGTACCGGTGGTGTCCG<br>TGCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | TCACCATCAGCAGCCTGCAGCCTG<br>AAGATTTTGCAACTTATTACTGCCA<br>ACACTATAAAAGTGATTCCCGGAC<br>GTTCGGCCAAGGGACCAAGGTGGA<br>AATCAAACGTACTGTGGCTGCTCC<br>CTCCGTGTTCATTTTTCCTCCGTCG<br>GACGAACAGCTGAAGTCCGGAACC<br>GCGTCCGTGGTCTGTCTCCTGAACA<br>ACTTCTATCCGCGCGAGGCGAAAG<br>TGCAGTGGAAGGTCGACAACGCAC<br>TGCAGTCGGGAAACTCCCAGGAAT<br>CGGTGACCGAGCAGGACTCGAAGG<br>ACTCAACCTACTCATTGTCCTCCAC<br>CCTCACCCTGAGCAAGGCCGATTA<br>CGAGAAGCATAAGGTCTACGCCTG<br>CGAAGTGACCCACCAGGGCCTGAG<br>CAGCCCAGTGACGAAGTCCTTCAA<br>CCGGGGAGAATGC |
| SEQ ID<br>1757 | CAGATGCAGCTGGTGCAATCTGGGG<br>GAGGCCTGGTCAAGGCTGGGGGGTC<br>CCTGAGACTCTCCTGTTCAGCCTCTG<br>GATTCACCTTCAGTAGCTATGCTATG<br>CACTGGGTCCGCCAGGCTCCAGGGA<br>AGGGACTGGAATATGTTTCAGCTATT<br>AGTAGTAATGGGGGTAGCACATACT<br>ACGCAGACTCAGTGAAGGGCAGATT<br>CACCATCTCCAGAGACAATTCCAAG<br>AACACGCTGTATCTTCAAATGAGCAG<br>TCTGAGAGCTGAGGACACGGCTGTG<br>TATTACTGTGTGAATCGGGCGGGTTA<br>CGGTGACTACAGACACTTCCAGCACT<br>GGGGCCAGGGCACCCTGGTCACCGT<br>CTCCTCAGCATCCACCAAGGGGCCTT<br>CCGTGTTCCCCCTGGCCCCTTCATCC<br>AAGTCGACCTCTGGTGGAACCGCCG<br>CACTCGGTTGCCTGGTCAAAGACTAC<br>TTCCCCGAGCCCGTGACTGTCTCGTG<br>GAACTCGGGCGCCCTCACATCCGGA<br>GTGCATACCTTTCCCGCCGTGTTGCA<br>GTCCAGCGGCCTGTACAGCCTGAGCT<br>CCGTCGTGACAGTGCCGTCCTCCTCC<br>CTTGGAACCCAGACCTATATCTGCAA<br>CGTCAATCACAAGCCCTCCAACACCA<br>AAGTGGACAAGAAGGTCGAACCCAA<br>GTCCTGCGACAAGACTCACACCTGTC<br>CGCCTTGTCCAGCCCCTGAGCTGCTG<br>GGTGGTCCGTCCGTGTTCCTCTTCCC<br>GCCCAAGCCGAAGGACACTCTGATG | SEQ ID<br>1865 | GATGTTGTGATGACTCAGTCTCCAT<br>CCTCCCTCGCTGCATCTGTTGGAGA<br>CAGAATTACCATCACTTGCCGGCC<br>AAGTCAGGACATAGGCACTTATTT<br>AAATTGGTATCAACAGAAGGCAGG<br>GGAAGCCCCTAAGCTCCTCATCTAT<br>GCTGCCTCCAATCTGCACAGTGGC<br>GTCTCATCAAGGTTCAGAGGCGTT<br>GGGTCTGGGACACAATTCACTCTC<br>ACCATCAGCAGTCTGCAACCTGAG<br>GATTTTGCAACTTACTACTGTCATC<br>AGAGTTACGGTCCTCGGACATTCG<br>GCCAAGGGACCAAGCTGGAGATCA<br>AACGTACTGTGGCTGCTCCCTCCGT<br>GTTCATTTTTCCTCCGTCGGACGAA<br>CAGCTGAAGTCCGGAACCGCGTCC<br>GTGGTCTGTCTCCTGAACAACTTCT<br>ATCCGCGCGAGGCGAAAGTGCAGT<br>GGAAGGTCGACAACGCACTGCAGT<br>CGGGAAACTCCCAGGAATCGGTGA<br>CCGAGCAGGACTCGAAGGACTCAA<br>CCTACTCATTGTCCTCCACCCTCAC<br>CCTGAGCAAGGCCGATTACGAGAA<br>GCATAAGGTCTACGCCTGCGAAGT<br>GACCCACCAGGGCCTGAGCAGCCC<br>AGTGACGAAGTCCTTCAACCGGGG<br>AGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | ATTTCACGCACCCCGGAAGTCACTTG CGTGGTCGTGGACGTGTCGCACGAA GATCCCGAAGTGAAATTCAATTGGTA CGTGGATGGGGTCGAAGTGCACAAC GCCAAGACCAAGCCTAGGGAAGAAC AGTACAACTCTACGTACCGGGTGGTG TCCGTGCTGACCGTGCTGCACCAGGA CTGGCTGAACGGAAAGGAGTACAAG TGCAAAGTGTCAAACAAGGCTCTCCC TGCCCCTATCGAAAAGACCATCAGC AAGGCCAAGGGTCAACCTAGGGAGC CCCAGGTCTATACTTTGCCGCCTAGC CGGGAAGAAATGACTAAGAACCAAG TGTCCCTGACTTGCCTTGTCAAGGGC TTTTATCCGTCCGACATCGCCGTGGA GTGGGAGTCCAACGGACAACCGGAG AACAACTACAAGACCACCCCACCGG TGCTCGATTCCGATGGCTCCTTCTTC CTGTACTCCAAGCTGACTGTGGACAA GTCAAGATGGCAGCAGGGAAACGTG TTCTCCTGCTCCGTGATGCACGAAGC GCTGCACAACCATTACACCCAGAAA TCACTGTCACTTTCGCCGGGAAAA | | |
| SEQ ID 1758 | GAGGTGCAGCTGGTGCAGTCTGGGG GAGGCGTGGTCCAGCCTGGGGGGTC CCTGAGACTCTCCTGTGCAGCGTCTG GATTCACCTTCAGTAGCTATGGCATG CACTGGGTCCGCCAGGCTCCAGGCA AGGGGCTGGAGTGGGTGGCATTTAT ATCATATGATGGAAGTAATAAATACT ACGCAGACTCCGTGAAGGGCCGATT CACCATCTCCAGAGACAATTCCAAG AACACGCTGTATCTGCAAATGAACA GCCTGAGAGCCGAGGACACGGCCGT ATATTACTGTGCGACAACAGGGGAC CGCTTCCAAGAGTTTGACTACTGGGG CCAGGGAACCCTGGTCACCGTCTCCT CAGCATCCACCAAGGGGCCTTCCGTG TTCCCCCTGGCCCCTTCATCCAAGTC GACCTCTGGTGGAACCGCCGCACTCG GTTGCCTGGTCAAAGACTACTTCCCC GAGCCCGTGACTGTCTCGTGGAACTC GGGCGCCCTCACATCGGAGTGCAT ACCTTTCCCGCCGTGTTGCAGTCCAG CGGCCTGTACAGCCTGAGCTCCGTCG TGACAGTGCCGTCCTCCTCCCTTGGA ACCCAGACCTATATCTGCAACGTCAA TCACAAGCCCTCCAACACCAAAGTG GACAAGAAGGTCGAACCCAAGTCCT GCGACAAGACTCACACCTGTCCGCCT TGTCCAGCCCCTGAGCTGCTGGGTGG TCCGTCCGTGTTCCTCTTCCCGCCCA AGCCGAAGGACACTCTGATGATTTCA CGCACCCCGGAAGTCACTTGCGTGGT CGTGGACGTGTCGCACGAAGATCCC GAAGTGAAATTCAATTGGTACGTGG ATGGGGTCGAAGTGCACAACGCCAA GACCAAGCCTAGGGAAGAACAGTAC AACTCTACGTACCGGGTGGTGTCCGT GCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT | SEQ ID 1866 | GAAACGACACTCACGCAGTCTCCA GCCACCCTGTCTGTGTCTCCAGGGG AAAGAGCCACCCTCTCCTGCAGGG CCAGTCAGAGTGTTAGCAGCAACT TAGCCTGGTACCAGCAGAAACCTG GCCAGGCTCCCAGGCTCCTCATCTA TGGTGCATCCACCAGGGCCACTGG CATCCCAGCCAGGTTCAGTGGCAG TGGGTCTGGGACAGAGTTCACTCT CACCATCAGCAGCCTGCAGTCTGA AGATTTTGCAGTTTATTACTGTCAG CAGTATAATAACTGGCCTCCGATC ACCTTCGGCCAAGGGACACGACTG GAGATTAAACGTACTGTGGCTGCT CCCTCCGTGTTCATTTTTCCTCCGT CGGACGAACAGCTGAAGTCCGGAA CCGCGTCCGTGGTCTGTCTCCTGAA CAACTTCTATCCGCGCGAGGCGAA AGTGCAGTGGAAGGTCGACAACGC ACTGCAGTCGGGAAACTCCCAGGA ATCGGTGACCGAGCAGGACTCGAA GGACTCAACCTACTCATTGTCCTCC ACCCTCACCCTGAGCAAGGCCGAT TACGAGAAGCATAAGGTCTACGCC TGCGAAGTGACCCACCAGGGCCTG AGCAGCCCAGTGACGAAGTCCTTC AACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCTGCTCCGTGATGCACGAAGCGCTG CACAACCATTACACCCAGAAATCACT GTCACTTTCGCCGGGAAAA | | |
| SEQ ID 1759 | CAGATGCAGCTGGTGCAGTCTGGGG GAGTCTTGCTTCAGCCAGGGCGGTCC CTGAGACTCTCCTGTACAGCTTCTGG ATTCACCTTTGCTGCTTATAATATCA ACTGGTTCCGCCAGGGTCCTGGGGG GGGGCTGGAGTGGGTAGGTTTCATTA GAGCCAACGCTGATAGTGGGACAAC AGAGTACGCCGTCTGTGAAAGGC AGATTCTTCATCTCAAGAGATGATTC CAGAAGCACCGCCTACCTGCAAATG ACTAGCCTTAAAACCGAGGACACAG CCGTTTATTACTGTGCCAGAGATGAT CGGGGTCGGGGAGATGACTTTGACT ACTGGGGCCAGGGCACCCTGGTCAC CGTCTCCTCAGCATCCACCAAGGGGC CTTCCGTGTTCCCCCTGGCCCCTTCAT CCAAGTCGACCTCTGGTGGAACCGCC GCACTGGTTGCCTGGTCAAAGACTA CTTCCCCGAGCCCGTGACTGTCTCGT GGAACTCGGGCGCCCTCACATCCGG AGTGCATACCTTTCCCGCCGTGTTGC AGTCCAGCGGCCTGTACAGCCTGAG CTCCGTCGTGACAGTGCCGTCCTCCT CCCTTGGAACCCAGACCTATATCTGC AACGTCAATCACAAGCCCTCCAACA CCAAAGTGGACAAGAAGGTCGAACC CAAGTCCTGCGACAAGACTCACACCT GTCCGCCTTGTCCAGCCCCTGAGCTG CTGGGTGGTCCGTCCGTGTTCTCTT CCCGCCCAAGCCGAAGGACACTCTG ATGATTTCACGCACCCCGGAAGTCAC TTGCGTGGTCGTGGACGTGTCGCACG AAGATCCCGAAGTGAAATTCAATTG GTACGTGGATGGGGTCGAAGTGCAC AACGCCAAGACCAAGCCTAGGGAAG AACAGTACAACTCTACGTACCGGGT GGTGTCCGTGCTGACCGTGCTGCACC AGGACTGGCTGAACGGAAAGGAGTA CAAGTGCAAAGTGTCAAACAAGGCT CTCCCTGCCCCTATCGAAAAGACCAT CAGCAAGGCCAAGGGTCAACCTAGG GAGCCCCAGGTCTATACTTTGCCGCC TAGCCGGGAAGAAATGACTAAGAAC CAAGTGTCCCTGACTTGCCTTGTCAA GGGCTTTTATCCGTCCGACATCGCCG TGGAGTGGGAGTCCAACGGACAACC GGAGAACAACTACAAGACCACCCCA CCGGTGCTCGATTCCGATGGCTCCTT CTTCCTGTACTCCAAGCTGACTGTGG ACAAGTCAAGATGGCAGCAGGGAAA CGTGTTCTCCTGCTCCGTGATGCACG AAGCGCTGCACAACCATTACACCCA GAAATCACTGTCACTTTCGCCGGGAA AA | SEQ ID 1867 | GATGTTGTGATGACTCAGTCTCCAG GCACCCTGTCTTTGTCTCCAGGGGA AAGAGCCACCCTCTCCTGCAGGGC CAGTCAGAGTGTTAGCAGCAGCTA CTTAGCCTGGTACCAGCAGAAACC TGGCCAGGCTCCCAGGCTCCTCATC TATGGTGCATCCAGCAGGGCCACT GGCATCCCAGACAGGTTCAGTGGC AGTGGGTCTGGGACAGACTTCACT CTCACCATCAGCAGACTGGAGCCT GAAGATTTTGCAGTGTATTACTGTC AGCAGTATGGTAGCTCAGGGTACA CTTTTGGCCAGGGGACCAAGCTGG AGATCAAACGTACTGTGGCTGCTC CCTCCGTGTTCATTTTTCCTCCGTC GGACGAACAGCTGAAGTCCGGAAC CGCGTCCGTGGTCTGTCTCCTGAAC AACTTCTATCCGCGCGAGGCGAAA GTGCAGTGGAAGGTCGACAACGCA CTGCAGTCGGGAAACTCCCAGGAA TCGGTGACCGAGCAGGACTCGAAG GACTCAACCTACTCATTGTCCTCCA CCCTCACCCTGAGCAAGGCCGATT ACGAGAAGCATAAGGTCTACGCCT GCGAAGTGACCCACCAGGGCCTGA GCAGCCCAGTGACGAAGTCCTTCA ACCGGGGAGAATGC |
| SEQ ID 1760 | CAGGTGCAGCTGGTGCAATCTGGGG GAGGCTTGGTACAGCCTGGGGGGTC CCTGAGACTCTCCTGTGCAGCCTCTG GATTCACCTTTAGCAGCTATGGCATG ACGTGGGTCCGCCAGGCTCCAGGGA AGGGGCTGGAGTGGGTCTCAACTATT AGTGGTAATGGTGTTGGCACATACTA CCCAGACTCCGTGAAGGACCGGTTC ACCATCTCCAGAGACAGTTCCAAGA ACACGGTGTATCTGCAAATGAACAG CCTGAGAGCCGAGGACACGGCCGTA TATTACTGTGTGAAACATGGTAGGGC CGGAATAAACTGGTACTTCGATCTCT GGGGCCGTGGCACCCTGGTGACCGT CTCCTCAGCATCCACCAAGGGGCCTT CCGTGTTCCCCCTGGCCCCTTCATCC | SEQ ID 1868 | GAAACGACACTCACGCAGTCTCCA GGCACCCTGTCTTTGTCTCCAGGGG AAAAGAGCCACCCTCTCCTGCAGGG CCAGTCAGAGTGTTAGCAGCAGCT ACTTAGCCTGGTACCAGCAGAAAC CTGGCCAGGCTCCCAGGCTCCTCAT CTATGGTGCATCCAGCAGGGCCAC TGGCATCCCAGACAGGTTCAGTGG CAGTGGGTCTGGGACAGACTTCAC TCTCACCATCAGCAGACTGGAGCC TGAAGATTTTGCAGTGTATTACTGT CAGCAGTATGGTAGCTCGTTCGGC CAAGGGACACGACTGGAGATTAAA CGTACTGTGGCTGCTCCCTCCGTGT TCATTTTTCCTCCGTCGGACGAACA GCTGAAGTCCGGAACCGCGTCCGT |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | AAGTCGACCTCTGGTGGAACCGCCG<br>CACTCGGTTGCCTGGTCAAAGACTAC<br>TTCCCCGAGCCCGTGACTGTCTCGTG<br>GAACTCGGGCGCCCTCACATCCGGA<br>GTGCATACCTTTCCCGCCGTGTTGCA<br>GTCCAGCGGCCTGTACAGCCTGAGCT<br>CCGTCGTGACAGTGCCGTCCTCCTCC<br>CTTGGAACCCAGACCTATATCTGCAA<br>CGTCAATCACAAGCCCTCCAACACCA<br>AAGTGGACAAGAAGGTCGAACCCAA<br>GTCCTGCGACAAGACTCACACCTGTC<br>CGCCTTGTCCAGCCCTGAGCTGCTG<br>GGTGGTCCGTCCGTGTTCCTCTTCCC<br>GCCCAAGCCGAAGGACACTCTGATG<br>ATTTCACGCACCCCGGAAGTCACTTG<br>CGTGGTCGTGGACGTGTCGCACGAA<br>GATCCCGAAGTGAAATTCAATTGGTA<br>CGTGGATGGGTCGAAGTGCACAAC<br>GCCAAGACCAAGCCTAGGGAAGAAC<br>AGTACAACTCTACGTACCGGGTGGTG<br>TCCGTGCTGACCGTGCTGCACCAGGA<br>CTGGCTGAACGGAAAGGAGTACAAG<br>TGCAAAGTGTCAAACAAGGCTCTCCC<br>TGCCCCTATCGAAAAGACCATCAGC<br>AAGGCCAAGGGTCAACCTAGGGAGC<br>CCCAGGTCTATACTTTGCCGCCTAGC<br>CGGGAAGAAATGACTAAGAACCAAG<br>TGTCCCTGACTTGCCTTGTCAAGGGC<br>TTTTATCCGTCCGACATCGCCGTGGA<br>GTGGGAGTCCAACGGACAACCGGAG<br>AACAACTACAAGACCACCCCACCGG<br>TGCTCGATTCCGATGGCTCCTTCTTC<br>CTGTACTCCAAGCTGACTGTGGACAA<br>GTCAAGATGGCAGCAGGGAAACGTG<br>TTCTCCTGCTCCGTGATGCACGAAGC<br>GCTGCACAACCATTACACCCAGAAA<br>TCACTGTCACTTTCGCCGGGAAAA | | GGTCTGTCTCCTGAACAACTTCTAT<br>CCGCGCGAGGCGAAAGTGCAGTGG<br>AAGGTCGACAACGCACTGCAGTCG<br>GGAAACTCCCAGGAATCGGTGACC<br>GAGCAGGACTCGAAGGACTCAACC<br>TACTCATTGTCCTCCACCCTCACCC<br>TGAGCAAGGCCGATTACGAGAAGC<br>ATAAGGTCTACGCCTGCGAAGTGA<br>CCCACCAGGGCCTGAGCAGCCCAG<br>TGACGAAGTCCTTCAACCGGGGAG<br>AATGC |
| SEQ ID<br>1761 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCAACAGTGCT<br>GCTTGGAACTGGATCAGGCAGTCCCC<br>ATCGAGAGGCCTTGAGTGGCTGGGA<br>AGGACATACTACAGGTCCAAGTGGT<br>ATAATGATTATGCAGTATCTGTGAAA<br>AGTCGAATAACCATCAACCCAGACA<br>CATCCAAGAACCAGTTCTCCCTGCAG<br>CTGAACTCTGTGACTCCCGAGGACAC<br>GGCTGTGTATTACTGTGCAAGAGGG<br>GGAGGGCTTTGGGCTTTTGATATCTG<br>GGGCCAAGGGACCACGGTCACCGTC<br>TCCTCAGCATCCACCAAGGGGCCTTC<br>CGTGTTCCCCCTGGCCCCTTCATCCA<br>AGTCGACCTCTGGTGGAACCGCCGC<br>ACTCGGTTGCCTGGTCAAAGACTACT<br>TCCCCGAGCCCGTGACTGTCTCGTGG<br>AACTCGGGCGCCCTCACATCCGGAGT<br>GCATACCTTTCCCGCCGTGTTGCAGT<br>CCAGCGGCCTGTACAGCCTGAGCTCC<br>GTCGTGACAGTGCCGTCCTCCTCCCT<br>TGGAACCCAGACCTATATCTGCAACG<br>TCAATCACAAGCCCTCCAACACCAA<br>AGTGGACAAGAAGGTCGAACCCAAG<br>TCCTGCGACAAGACTCACACCTGTCC<br>GCCTTGTCCAGCCCTGAGCTGCTGG<br>GTGGTCCGTCCGTGTTCCTCTTCCCG<br>CCCAAGCCGAAGGACACTCTGATGA<br>TTTCACGCACCCCGGAAGTCACTTGC<br>GTGGTCGTGGACGTGTCGCACGAAG<br>ATCCCGAAGTGAAATTCAATTGGTAC<br>GTGGATGGGTCGAAGTGCACAACG<br>CCAAGACCAAGCCTAGGGAAGAACA<br>GTACAACTCTACGTACCGGGTGGTGT<br>CCGTGCTGACCGTGCTGCACCAGGAC | SEQ ID<br>1869 | GAAATTGTGTTGACACAGTCTCCTT<br>CCACCCTGTCTGCATCTGTAGGGG<br>ACAGAGTCACCATCACTTGCCGGG<br>CCAGTCAGAGTATTAGTAGCTGCTT<br>GGCCTGGTATCAGCAGAAACCAGG<br>GAAAGCCCCTAAGCTCCTGATCTA<br>TGCTGCATCCACTTTGCAAAGTGG<br>GGTCCCATCAAGGTTCAGCGGCAG<br>TGGATCTGGGACAGAATTCACTCT<br>CACAATCAGCACCCTGCAGCCTGA<br>AGATTTTGTGCAACTTATTACTGTCAA<br>CAGCTTAATAGTTACCCTCAGACGT<br>TCGGCCAAGGGACCAAAGTGGATA<br>TCAAACGTACTGTGGCTGCTCCCTC<br>CGTGTTCATTTTTCCTCCGTCGGAC<br>GAACAGCTGAAGTCCGGAACCGCG<br>TCCGTGGTCTGTCTCCTGAACAACT<br>TCTATCCGCGCGAGGCGAAAGTGC<br>AGTGGAAGGTCGACAACGCACTGC<br>AGTCGGGAAACTCCCAGGAATCGG<br>TGACCGAGCAGGACTCGAAGGACT<br>CAACCTACTCATTGTCCTCCACCCT<br>CACCCTGAGCAAGGCCGATTACGA<br>AGAGCATAAGGTCTACGCCTGCGA<br>AGTGACCCACCAGGGCCTGAGCAG<br>CCCAGTGACGAAGTCCTTCAACCG<br>GGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TGGCTGAACGGAAAGGAGTACAAGT GCAAAGTGTCAAACAAGGCTCTCCCT GCCCCTATCGAAAAGACCATCAGCA AGGCCAAGGGTCAACCTAGGGAGCC CCAGGTCTATACTTTGCCGCCTAGCC GGGAAGAAATGACTAAGAACCAAGT GTCCCTGACTTGCCTTGTCAAGGGCT TTTATCCGTCCGACATCGCCGTGGAG TGGGAGTCCAACGGACAACCGGAGA ACAACTACAAGACCACCCCACCGGT GCTCGATTCCGATGGCTCCTTCTTCC TGTACTCCAAGCTGACTGTGGACAAG TCAAGATGGCAGCAGGGAAACGTGT TCTCCTGCTCCGTGATGCACGAAGCG CTGCACAACCATTACACCCAGAAATC ACTGTCACTTTCGCCGGGAAAA | | |
| SEQ ID 1762 | GAGGTCCAGCTGGTGCAGTCTGGGG CTGAGGTGAAGAAGCCTGGGGCCTC AGTGAAGGTCTCCTGCAAGGCTTCTG GATACACCTTCACCGGCTACTATATG CACTGGGTGCGACAGGCCCCTGGAC AAGGGCTTGAGTGGATGGGATGGAT CAACCCTAACAGTGGTGGCACAAAC TATGCACAGAAGTTTCAGGGCAGGG TCACCATGACCAGGGACACGTCCATC AGCACAGCCTACATGGAGCTGAGCA GGCTGAGATCTGACGACACGGCCGT GTATTACTGTGCGAGAGACAAGATC GGCAGCTGTCCTTACTGGGGCCAGG GAACCCTGGTCACCGTCTCCTCAGCA TCCACCAAGGGGCCTTCCGTGTTCCC CCTGGCCCCTTCATCCAAGTCGACCT CTGGTGGAACCGCCGCACTCGGTTGC CTGGTCAAAGACTACTTCCCCGAGCC CGTGACTGTCTCGTGGAACTCGGGCG CCCTCACATCCGGAGTGCATACCTTT CCCGCCGTGTTGCAGTCCAGCGGCCT GTACAGCCTGAGCTCCGTCGTGACAG TGCCGTCCTCCTCCCTTGGAACCCAG ACCTATATCTGCAACGTCAATCACAA GCCCTCCAACACCAAAGTGGACAAG AAGGTCGAACCCAAGTCCTGCGACA AGACTCACACCTGTCCGCCTTGTCCA GCCCCTGAGCTGCTGGGTGGTCCGTC CGTGTTCCTCTTCCCGCCCAAGCCGA AGGACACTCTGATGATTTCACGCACC CCGGAAGTCACTTGCGTGGTCGTGGA CGTGTCGCACGAAGATCCCGAAGTG AAATTCAATTGGTACGTGGATGGGT CGAAGTGCACAACGCCAAGACCAAG CCTAGGGAAGAACAGTACAACTCTA CGTACCGGGTGGTGTCCGTGCTGACC GTGCTGCACCAGGACTGGCTGAACG GAAAGGAGTACAAGTGCAAAGTGTC AAACAAGGCTCTCCCTGCCCCTATCG AAAAGACCATCAGCAAGGCCAAGGG TCAACCTAGGGAGCCCCAGGTCTATA CTTTGCCGCCTAGCCGGGAAGAAAT GACTAAGAACCAAGTGTCCCTGACTT GCCTTGTCAAGGGCTTTTATCCGTCC GACATCGCCGTGGAGTGGGAGTCCA ACGGACAACCGGAGAACAACTACAA GACCACCCCACCGGTGCTCGATTCCG ATGGCTCCTTCTTCCTGTACTCCAAG CTGACTGTGGACAAGTCAAGATGGC AGCAGGGAAACGTGTTCTCCTGCTCC GTGATGCACGAAGCGCTGCACAACC ATTACACCCAGAAATCACTGTCACTT TCGCCGGGAAAA | SEQ ID 1870 | GATATTGTGATGACCCACACTCCA CTCTCTCTGTCCGTCACCCCTGGAC AGCCGGCCTCCATCTCCTGCAAGTC TAGTCAGAGCCTCCTGCATAGTGA TGGAAAGACCTATTTGTATTGGTAC CTGCAGAAGCCAGGCCAGCCTCCA CAGCTCCTGATCTATGAAGTTTCCA ACCGGTTCTCTGGAGTGCCAGATA GGTTCAGTGGCAGCGGGTCAGGGA CAGATTTCACACTGAAAATCAGCC GGGTGGAGGCTGAGGATGTTGGGG TTTATTACTGCATGCAAAGTATACA GCTTCCGCTCACTTTCGGCGGAGG GACCAAGGTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| SEQ ID 1763 | CAGGTCACCTTGAAGGAGTCTGGTCC TACGCTGGTGAAACCCACACAGACC CTCACGCTGACCTGCACCTTCTCTGG GTTCTCACTCAGCACTAGTGGAGTGG GTGTGGGCTGGATCCGTCAGCCCCCA GGAAAGGCCCTGGAGTGGCTTGCAC TCATTTATTGGGATGATGATAAGCGC TACAGCCCATCTCTGAAGAGCAGGCT CACCATCACCAAGGACACCTCCAAA AACCAGGTGGTCCTTACAATGACCA ACATGGACCCTGTGGACACAGCCAC ATATTACTGTGCACACAGACCGGATA GCAGCAGTCAATGTTTTGACTACTGG GGCCAGGGAACCCTGGTCACCGTCTC CTCAGCATCCACCAAGGGGCCTTCCG TGTTCCCCCTGGCCCCTTCATCCAAG TCGACCTCTGGTGGAACCGCCGCACT CGGTTGCCTGGTCAAAGACTACTTCC CCGAGCCCGTGACTGTCTCGTGGAAC TCGGGCGCCCTCACATCCGGAGTGCA TACCTTTCCCGCCGTGTTGCAGTCCA GCGGCCTGTACAGCCTGAGCTCCGTC GTGACAGTGCCGTCCTCCTCCCTTGG AACCCAGACCTATATCTGCAACGTCA ATCACAAGCCCTCCAACACCAAAGT GGACAAGAAGGTCGAACCCAAGTCC TGCGACAAGACTCACACCTGTCCGCC TTGTCCAGCCCCTGAGCTGCTGGGTG GTCCGTCCGTGTTCCTCTTCCCGCCC AAGCCGAAGGACACTCTGATGATTTC ACGCACCCCGGAAGTCACTTGCGTG GTCGTGGACGTGTCGCACGAAGATC CCGAAGTGAAATTCAATTGGTACGTG GATGGGGTCGAAGTGCACAACGCCA AGACCAAGCCTAGGGAAGAACAGTA CAACTCTACGTACCGGGTGGTGTCCG TGCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | SEQ ID 1871 | GATGTTGTGATGACTCAGTCTCCAG GCACCCTGTCTTTGTCTCCAGGGGA AAGAGCCACCCTCTCCTGCAGGGC CAGTCAGAGTGTTAGCAGCAGCTA CTTAGCCTGGTACCAGCAGAAACC TGGCCAGGCTCCCAGGCTCCTCATC TATGGTGCATCCAGCAGGGCCACT GGCATCCCAGACAGGTTCAGTGGC AGTGGGTCTGGGACAGACTTCACT CTCACCATCAGCAGACTGGAGCCT GAAGATTTTGCAGTGTATTACTGTC AGCAGTATAATAACTGGCCTCTCA CTTTCGGCGGAGGGACCAAGCTGG AGATCAAACGTACTGTGGCTGCTC CCTCCGTGTTCATTTTTCCTCCGTC GGACGAACAGCTGAAGTCCGGAAC CGCGTCCGTGGTCTGTCTCCTGAAC AACTTCTATCCGCGCGAGGCGAAA GTGCAGTGGAAGGTCGACAACGCA CTGCAGTCGGGAAACTCCCAGGAA TCGGTGACCGAGCAGGACTCGAAG GACTCAACCTACTCATTGTCCTCCA CCCTCACCCTGAGCAAGGCCGATT ACGAGAAGCATAAGGTCTACGCCT GCGAAGTGACCCACCAGGGCCTGA GCAGCCCAGTGACGAAGTCCTTCA ACCGGGGAGAATGC |
| SEQ ID 1764 | CAGGTCACCTTGAAGGAGTCTGGGG GAGGCGTGGTCCAGCCTGGGAGGTC CCTGAGACTCTCCTGTGCAGCCTCTG GATTCACCTTCAGTAGCTATGCTATG CACTGGGTCCGCCAGGCTCCAGGCA AGGGGCTGGAGTGGGTGGCAGTTAT ATCATATGATGGAAGTAATAAATACT ACGCAGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCGAGAAGCAGTGGCC GGTCACTGCCTGAAGACTACTGGGG CCAGGGAACCCTGGTCACCGTCTCCT CAGCATCCACCAAGGGGCCTTCCGTG TTCCCCCTGGCCCCTTCATCCAAGTC GACCTCTGGTGGAACCGCCGCACTCG GTTGCCTGGTCAAAGACTACTTCCCC GAGCCCGTGACTGTCTCGTGGAACTC GGGCGCCCTCACATCCGGAGTGCAT ACCTTTCCCGCCGTGTTGCAGTCCAG | SEQ ID 1872 | GACATCCAGTTGACCCAGTCTCCC GACTCCCTGGCTGTGTCTCTGGGCG AGAGGGCCACCATCAACTGCACGT CCAGCCAGAGTGTTTTTATACAGCTC CAACAATAAGAACTACATAGCTTG GTACCAGCAGAAACCAGGACAGCC TCCTAAGCTGCTCATTTACTGGGCA TCTACCCGGGAATCCGGGGTCCCT GACCGATTCAGTGGCAGCGGGTCT GGGACAGATTTCACTCTCACCATC AGCAGCCTGCAGGCTGAAGATGTG GCAGTTTATTACTGTCAGCAATATT ATTATATTCCTCGGACGTTCGGCCA AGGGACCAAGGTGGAAATCAAACG TACTGTGGCTGCTCCCTCCGTGTTC ATTTTTCCTCCGTCGGACGAACAGC TGAAGTCCGGAACCGCGTCCGTGG TCTGTCTCCTGAACAACTTCTATCC GCGCGAGGCGAAAGTGCAGTGGAA GGTCGACAACGCACTGCAGTCGGG AAACTCCCAGGAATCGGTGACCGA |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | GCAGGACTCGAAGGACTCAACCTA<br>CTCATTGTCCTCCACCCTCACCCTG<br>AGCAAGGCCGATTACGAGAAGCAT<br>AAGGTCTACGCCTGCGAAGTGACC<br>CACCAGGGCCTGAGCAGCCCAGTG<br>ACGAAGTCCTTCAACCGGGGAGAA<br>TGC |
| SEQ ID<br>1765 | CAGGTCCAGCTGGTACAGTCTGGGG<br>CTGAGGTGAAGAAGCCTGGGGCCTC<br>AGTGAAGGTCTCCTGCAAGGTTTCCG<br>GATACACCCTCACTGAATTATCCATG<br>CACTGGGTGCGACAGGCTCCTGGAA<br>AAGGGCTTGAGTGGATGGGAGGTTT<br>TGATCCTGAAGATGGTGAAACAATCT<br>ACGCACAGAAGTTCCAGGGCAGAGT<br>CACCATGACCGAGGACACATCTACA<br>GACACAGCCTACATGGAGCTGAGCA<br>GCCTGAGATCTGAGGACACGGCCGT<br>GTATTACTGTGCAACGGATGTGAACC<br>CGGAGCTACTGGGGCGGGATTTGA<br>CTACTGGGGCCAGGGCACCCTGGTC<br>ACCGTCTCCTCAGCATCCACCAAGGG<br>GCCTTCCGTGTTCCCCCTGGCCCCTT<br>CATCCAAGTCGACCTCTGGTGGAACC<br>GCCGCACTCGGTTGCCTGGTCAAAGA<br>CTACTTCCCCGAGCCCGTGACTGTCT<br>CGTGGAACTCGGGCGCCCTCACATCC<br>GGAGTGCATACCTTTCCCGCCGTGTT<br>GCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG | SEQ ID<br>1873 | GATGTTGTGATGACTCAGTCTCCAC<br>TCTCCCTGCCCGTCACCCCTGGAGA<br>GCCGGCCTCCATCTCCTGCAGGTCT<br>AGTCAGAGCCTCCTGCATAGTAAT<br>GGATACAACTATTTGGATTGGTAC<br>CTGCAGAAGCCAGGGCAGTCTCCA<br>CAGCTCCTGATCTATTTGGGTTCTA<br>ATCGGGCCCCCGGGGTCCCTGACA<br>GGTTCAGTGGCAGTGGATCAGGCA<br>CAGATTTTACACTGAAAATCAGCA<br>GAGTGGAGGCTGAGGATGTTGGGG<br>TTTATTACTGCATGCAAGCTCTACA<br>AACTCGGACATTCGGCCAAGGGAC<br>CAAGCTGGAGATCAAACGTACTGT<br>GGCTGCTCCCTCCGTGTTCATTTTT<br>CCTTCCGTCGGACGAACAGCTGAAG<br>TCCGGAACCGCGTCCGTGGTCTGTC<br>TCCTGAACAACTTCTATCCGCGCGA<br>GGCGAAAGTGCAGTGGAAGGTCGA<br>CAACGCACTGCAGTCGGGAAACTC<br>CCAGGAATCGGTGACCGAGCAGGA<br>CTCGAAGGACTCAACCTACTCATT<br>GTCCTCCACCCTCACCCTGAGCAA<br>GGCCGATTACGAGAAGCATAAGGT<br>CTACGCCTGCGAAGTGACCCACCA<br>GGGCCTGAGCAGCCCAGTGACGAA<br>GTCCTTCAACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | | |
| SEQ ID 1766 | CAGGTCACCTTGAAGGAGTCTGGGG<br>GAGGCTTGGTCCAGCCTGGAGGGTC<br>CCTGAGACTCTCCTGTGCAGCCTCTG<br>GATTCACCTTCAGTGACCAGTACATG<br>GACTGGGTCCGCCAGGCTCCAGGGA<br>AGGGGCTGGAGTGGGTTGGCCGTGT<br>TAGAAACAAAGCTAACAGTTACACC<br>ACAGAATACGCCGCGTCTGTGAAAG<br>GCAGATTCACCATCTCAAGAGATGAT<br>TCAAAGAACTCACTGTATCTGCAAAT<br>GAATAGTCTGAACACCGAGGACACG<br>GCCATGTATTTCTGTGCTAGTAGTCT<br>CAATAGTGGGGGCTACCGATGCTTCC<br>ATCACTGGGGCCAGGGCACCCTGGT<br>GACCGTCTCCTCAGCATCCACCAAGG<br>GCCCTTCCGTGTTCCCCCTGGCCCCT<br>TCATCCAAGTCGACCTCTGGTGGAAC<br>CGCCGCACTCGGTTGCCTGGTCAAAG<br>ACTACTTCCCCGAGCCCGTGACTGTC<br>TCGTGGAACTCGGGCGCCCTCACATC<br>CGGAGTGCATACCTTTCCCGCCGTGT<br>TGCAGTCCAGCGGCCTGTACAGCCTG<br>AGCTCCGTCGTGACAGTGCCGTCCTC<br>CTCCCTTGGAACCCAGACCTATATCT<br>GCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | SEQ ID 1874 | GAAACGACACTCACGCAGTCTCCA<br>GGCACCCTGTCTTTGTCTCCAGGGG<br>AAAGAGCCACCCTCTCCTGCAGGG<br>CCAGTCAGAGTCTTACCAGCAGCT<br>ACTTAGCCTGGTACCAGCAGAAAC<br>CTGGCCAGGCTCCCAGACTCCTCAT<br>CTATCGTGCATCCAGCAGGGCCAC<br>TGGCATCCCAGACCGGTTCAGTGG<br>CAGTGGGTCTGGGACAGACTTCAC<br>TCTCACCATCAGCAGACTGGAGCC<br>TGAAGATTTTGCAGTTTATTACTGT<br>CAGCAGTATGGTAGTTCACCTAAC<br>ACCTTCGGCCAAGGGACACGACTG<br>GAGATTAAACGTACTGTGGCTGCT<br>CCCTCCGTGTTCATTTTTCCTCCGT<br>CGGACGAACAGCTGAAGTCCGGAA<br>CCGCGTCCGTGGTCTGTCTCCTGAA<br>CAACTTCTATCCGCGCGAGGCGAA<br>AGTGCAGTGGAAGGTCGACAACGC<br>ACTGCAGTCGGGAAACTCCCAGGA<br>ATCGGTGACCGAGCAGGACTCGAA<br>GGACTCAACCTACTCATTGTCCTCC<br>ACCCTCACCCTGAGCAAGGCCGAT<br>TACGAGAAGCATAAGGTCTACGCC<br>TGCGAAGTGACCCACCAGGGCCTG<br>AGCAGCCCAGTGACGAAGTCCTTC<br>AACCGGGGAGAATGC |
| SEQ ID 1767 | CAGGTCCAGCTGGTGCAGTCTGGGG<br>GAGGCTTGGTCCAGCCTGGGGGGTC<br>CCTGAGACTCTCCTGTTCAGCCTCTG<br>GATTCACCTTCAGTAGCTATGCTATG<br>CACTGGGTCCGCCAGGCTCCAGGGA<br>AGGGACTGGAATATGTTTCAGCTATT<br>AGTAGTAATGGGGGTAGCACATACT | SEQ ID 1875 | GAAATTGTGTTGACACAGTCTCCA<br>CTCTCCCTGCCCGTCACCCTTGGAC<br>AGCCGGCCTCCATCTCCTGCAGGTC<br>TAGTCAAAGCCTCGTACACAGTAA<br>TGGACACACCTACTTGAGTTGGTTT<br>CAGCAGAGGCCAGGCCAATCTCCA<br>AGGCGCCTCATTTATGAGGTTTCTA |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACGCAGACTCAGTGAAGGGCAGATT CACCATCTCCAGAGACAATTCCAAG AACACGCTGTATCTTCAAATGAGCAG TCTGAGAGCTGAGGACACGGCTGTG TATTACTGTGTGAAAGCGCCGAGGG GTGTAGTACCAGCTGCTATGCGGGG GGGCTACTGGGGCCAGGGAACCCTG GTCACCGTCTCCTCAGCATCCACCAA GGGGCCTTCCGTGTTCCCCCTGGCCC CTTCATCCAAGTCGACCTCTGGTGGA ACCGCCGCACTCGGTTGCCTGGTCAA AGACTACTTCCCCGAGCCCGTGACTG TCTCGTGGAACTCGGGCGCCCTCACA TCCGGAGTGCATACCTTTCCCGCCGT GTTGCAGTCCAGCGGCCTGTACAGCC TGAGCTCCGTCGTGACAGTGCCGTCC TCCTCCCTTGGAACCCAGACCTATAT CTGCAACGTCAATCACAAGCCCTCCA ACACCAAAGTGGACAAGAAGGTCGA ACCCAAGTCCTGCGACAAGACTCAC ACCTGTCCGCCTTGTCCAGCCCTGA GCTGCTGGGTGGTCCGTCCGTGTTCC TCTTCCCGCCCAAGCCGAAGGACACT CTGATGATTTCACGCACCCCGGAAGT CACTTGCGTGGTCGTGGACGTGTCGC ACGAAGATCCCGAAGTGAAATTCAA TTGGTACGTGGATGGGGTCGAAGTG CACAACGCCAAGACCAAGCCTAGGG AAGAACAGTACAACTCTACGTACCG GGTGGTGTCCGTGCTGACCGTGCTGC ACCAGGACTGGCTGAACGGAAAGGA GTACAAGTGCAAAGTGTCAAACAAG GCTCTCCCTGCCCCTATCGAAAAGAC CATCAGCAAGGCCAAGGGTCAACCT AGGGAGCCCCAGGTCTATACTTTGCC GCCTAGCCGGGAAGAAATGACTAAG AACCAAGTGTCCCTGACTTGCCTTGT CAAGGGCTTTTATCCGTCCGACATCG CCGTGGAGTGGGAGTCCAACGGACA ACCGGAGAACAACTACAAGACCACC CCACCGGTGCTCGATTCCGATGGCTC CTTCTTCCTGTACTCCAAGCTGACTG TGGACAAGTCAAGATGGCAGCAGGG AAACGTGTTCTCCTGCTCCGTGATGC ACGAAGCGCTGCACAACCATTACAC CCAGAAATCACTGTCACTTTCGCCGG GAAAA | | ACCGGGACTCTGGTGTCCCAGACA GATTCAGCGGCAGTGGGTCAGGCA CTGATTTCACACTAAGAATCAGCA GGGTGGAGGCTGAGGATGTTGGGG TTTATTACTGCTTGCAAGGAACACA CTGGCCCCCCCTCACTGTCGGCGG AGGGACCAAAGTGGATATCAAACG TACTGTGGCTGCTCCCTCCGTGTTC ATTTTTCCTCCGTCGGACGAACAGC TGAAGTCCGGAACCGCGTCCGTGG TCTGTCTCCTGAACAACTTCTATCC GCGCGAGGCGAAAGTGCAGTGGAA GGTCGACAACGCACTGCAGTCGGG AAACTCCCAGGAATCGGTGACCGA GCAGGACTCGAAGGACTCAACCTA CTCATTGTCCTCCACCCTCACCCTG AGCAAGGCCGATTACGAGAAGCAT AAGGTCTACGCCTGCGAAGTGACC CACCAGGGCCTGAGCAGCCCAGTG ACGAAGTCCTTCAACCGGGGAGAA TGC |
| SEQ ID 1768 | CAGGTGCAGCTGCAGGAGTCGGGGG GAGGCTTGGTACAGCCAGGGCGGTC CCTGAGACTCTCCTGTACAGCTTCTG GATTCACCTTTGGTGATTATGCTATG AGCTGGTTCCGCCAGGCTCCAGGGA AGGGGCTGGAGTGGGTAGGTTTCATT AGAAGCAAAGCTTATGGTGGGACAA CAGAATACGCCGCGTCTGTGAAAGG CAGATTCACCATCTCAAGAGATGATT CCAAAAGCATCGCCTATCTGCAAATG AACAGCCTGAAAACCGAGGACACAG CCGTGTATTACTGTACTAGATTGGTG GGCAATAGTGGGAGCTACTATCCGTT TGGGTACTGGGGCCAGGGAACCCTG GTGACCGTCTCCTCAGCATCCACCAA GGGGCCTTCCGTGTTCCCCCTGGCCC CTTCATCCAAGTCGACCTCTGGTGGA ACCGCCGCACTCGGTTGCCTGGTCAA AGACTACTTCCCCGAGCCCGTGACTG TCTCGTGGAACTCGGGCGCCCTCACA TCCGGAGTGCATACCTTTCCCGCCGT GTTGCAGTCCAGCGGCCTGTACAGCC TGAGCTCCGTCGTGACAGTGCCGTCC TCCTCCCTTGGAACCCAGACCTATAT CTGCAACGTCAATCACAAGCCCTCCA ACACCAAAGTGGACAAGAAGGTCGA ACCCAAGTCCTGCGACAAGACTCAC | SEQ ID 1876 | GATGTTGTGATGACTCAGTCTCCAG CCACCCTGTCTTTGTCTCCAGGGGA AAGAGCCACCCTCTCCTGCAGGGC CAGTCAGAGTGTTGGCAGCGACTT AGCCTGGTACCAGCAGAAACCTGG CCAGGCTCCCAGGCTCCTCATCTAC CGTGCATCCACCAGGGCCGCTGGT ATCCCAGCCAGGTTCAGTGGCAGT GGGTCTGGGACAGACTTCACTCTC ACCATCAGCAGACTGGAGCCTGAA GATTTTGCAGTGTTTTACTGTCAGC AGTATGGTAGATACCGTACACTTT CTGGCCAGGGGACCAAGCTGGAGA TCAAACGTACTGTGGCTGCTCCCTC CGTGTTCATTTTTCCTCCGTCGGAC GAACAGCTGAAGTCCGGAACCGCG TCCGTGGTCTGTCTCCTGAACAACT TCTATCCGCGCGAGGCGAAAGTGC AGTGGAAGGTCGACAACGCACTGC AGTCGGGAAACTCCCAGGAATCGG TGACCGAGCAGGACTCGAAGGACT CAACCTACTCATTGTCCTCCACCCT CACCCTGAGCAAGGCCGATTACGA GAAGCATAAGGTCTACGCCTGCGA AGTGACCCACCAGGGCCTGAGCAG CCCAGTGACGAAGTCCTTCAACCG GGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACCTGTCCGCCTTGTCCAGCCCCTGA GCTGCTGGGTGGTCCGTCCGTGTTCC TCTTCCCGCCCAAGCCGAAGGACACT CTGATGATTTCACGCACCCCGGAAGT CACTTGCGTGGTCGTGGACGTGTCGC ACGAAGATCCCGAAGTGAAATTCAA TTGGTACGTGGATGGGGTCGAAGTG CACAACGCCAAGACCAAGCCTAGGG AAGAACAGTACAACTCTACGTACCG GGTGGTGTCCGTGCTGACCGTGCTGC ACCAGGACTGGCTGAACGGAAAGGA GTACAAGTGCAAAGTGTCAAACAAG GCTCTCCCTGCCCCTATCGAAAAGAC CATCAGCAAGGCCAAGGGTCAACCT AGGGAGCCCCAGGTCTATACTTTGCC GCCTAGCCGGGAAGAAATGACTAAG AACCAAGTGTCCCTGACTTGCCTTGT CAAGGGCTTTTATCCGTCCGACATCG CCGTGGAGTGGGAGTCCAACGGACA ACCGGAGAACAACTACAAGACCACC CCACCGGTGCTCGATTCCGATGGCTC CTTCTTCCTGTACTCCAAGCTGACTG TGGACAAGTCAAGATGGCAGCAGGG AAACGTGTTCTCCTGCTCCGTGATGC ACGAAGCGCTGCACAACCATTACAC CCAGAAATCACTGTCACTTTCGCCGG GAAAA | | |
| SEQ ID 1769 | CAGGTGCAGCTACAGCAGTGGGGCG CAGGACTGTTGAAGCCTTCGGAGAC CCTGTCCCTCACCTGCGCTGTCTATG GTGGGTCCTTCAGTGGTTACTACTGG AGCTGGATCCGCCAGCCCCCAGGGA AGGGGCTGGAGTGGATTGGGGAAAT CAATCATAGTGGAAGCACCAACTAC AACCCGTCCCTCAAGAGTCGAGTCAC CATATCAGTAGACACGTCCAAGAAC CAGTTCTCCCTGAAGCTGAGCTCGGT GACCGCCGCGGACACGGCTGTGTATT ACTGTGCGAGAGGCCGGTCCCTTCCC TACCGGGGTTGGCTCCTAGATCTTT CGGAGGATACTACTTTGACTACTGGG GCCAGGGAACCCTGGTCACCGTCTCC TCAGCATCCACCAAGGGGCCTTCCGT GTTCCCCCTGGCCCCTTCATCCAAGT CGACCTCTGGTGGAACCGCCGCACTC GGTTGCCTGGTCAAAGACTACTTCCC CGAGCCCGTGACTGTCTCGTGGAACT CGGGCGCCCTCACATCCGGAGTGCAT ACCTTTCCGCCGTGTTGCAGTCCAG CGGCCTGTACAGCCTGAGCTCCGTCG TGACAGTGCCGTCCTCCTCCCCTTGGA ACCCAGACCTATATCTGCAACGTCAA TCACAAGCCCTCCAACACCAAAGTG GACAAGAAGGTCGAACCCAAGTCCT GCGACAAGACTCACACCTGTCCGCCT TGTCCAGCCCCTGAGCTGCTGGGTGG TCCGTCCGTGTTCCTCTTCCCGCCCA AGCCGAAGGACACTCTGATGATTTCA CGCACCCCGGAAGTCACTTGCGTGGT CGTGGACGTGTCGCACGAAGATCCC GAAGTGAAATTCAATTGGTACGTGG ATGGGGTCGAAGTGCACAACGCCAA GACCAAGCCTAGGGAAGAACAGTAC AACTCTACGTACCGGGTGGTGTCCGT GCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA | SEQ ID 1877 | GATATTGTGATGACCCACACTCCA GACTCCCTGGCTGTGTCTCTGGGCG AGAGGGCCACCATCAACTGCAAGT CCAGCCAGAGTGTTTTATACAGCTC CAACAATAAGAACTACTTAGCTTG GTACCAGCAGAAACCAGGACAGCC TCCTAAGCTGCTCATTTACTGGGCA TCTACCCGGGAATCGGGGTCCCT GACCGATTCAGTGGCAGCGGGTCT GGGACAGATTTCACTCTCACCATC AGCAGCCTGCAGGCTGAAGATGTG GCAGTTTATTACTGTCAGCAATATT ATAGTACTCCGCTCACTTTCGGCGG AGGGACCAAGGTGGAGATCAAACG TACTGTGGCTGCTCCCTCCGTGTTC ATTTTTCCTCCGTCGGACGAACAGC TGAAGTCCGGAACCGCGTCCGTGG TCTGTCTCCTGAACAACTTCTATCC GCGCGAGGCGAAAGTGCAGTGGAA GGTCGACAACGCACTGCAGTCGGG AAACTCCCAGGAATCGGTGACCGA GCAGGACTCGAAGGACTCAACCTA CTCATTGTCCTCCACCCTCACCCTG AGCAAGGCCGATTACGAGAAGCAT AAGGTCTACGCCTGCGAAGTGACC CACCAGGGCCTGAGCAGCCCAGTG ACGAAGTCCTTCAACCGGGGAGAA TGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | | |
| SEQ ID 1770 | CAGGTGCAGCTGCAGGAGTCGGGGG GAGGCTTGGTACGGCCTGGAGGGTC CCTGAGACTCTCCTGTGGAGACTCTG GATTCAACTTCAGTGATATGAAATG AACTGGGTCCGCCAGGCTCCAGGGA AGGGGCTGGAGTGGGTTTCATACGTC AGTACTAGTGGTAGTACCAGATACTA CGCAGACTCTGTGAAGGGCCGATTTA CCATCTCCAGAGACAACGCCAAGAA CACCCTGTATTTGCAAATGAACAGTC TGAGAGTCGAGGACACGGCTGTGTA TTACTGTGCAAGAGGACGGACTCACT GGGGCCCCCAGGACTTTGACTACTGG GGCCAGGGAACCCTGGTCACCGTCTC CTCAGCATCCACCAAGGGGCCTTCCG TGTTCCCCCTGGCCCCTTCATCCAAG TCGACCTCTGGTGGAACCGCCGCACT CGGTTGCCTGGTCAAAGACTACTTCC CCGAGCCCGTGACTGTCTCGTGGAAC TCGGGCGCCCTCACATCCGGAGTGCA TACCTTTCCCGCCGTGTTGCAGTCCA GCGGCCTGTACAGCCTGAGCTCCGTC GTGACAGTGCCGTCCTCCTCCCTTGG AACCCAGACCTATATCTGCAACGTCA ATCACAAGCCCTCCAACACCAAAGT GGACAAGAAGGTCGAACCCAAGTCC TGCGACAAGACTCACACCTGTCCGCC TTGTCCAGCCCCTGAGCTGCTGGGTG GTCGTCCGTGTTCCTCTTCCCGCCC AAGCCGAAGGACACTCTGATGATTTC ACGCACCCCGGAAGTCACTTGCGTG GTCGTGGACGTGTCGCACGAAGATC CCGAAGTGAATTCAATTGGTACGTG GATGGGGTCGAAGTGCACAACGCCA AGACCAAGCCTAGGGAAGAACAGTA CAACTCTACGTACCGGGTGGTGTCCG TGCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | SEQ ID 1878 | GAAATTGTGATGACGCAGTCTCCA CTCTCCCTGTCCGTCACCCCTGGAG AGCCGGCCTCCATCTCCTGCAGGTC TAGTCAGAGCCTCCTACATAGTAG TGGATACAACTATTTGGATTGGTAC CTGCAGAAGCCAGGCCAGTCTCCA CAGCTCCTGATCTATTTGGGTTCTA CTCGGGCCTCCGGGGTCCCTGACA GGTTCAGTGGCAGTGGATCAGGCA CAGATTTTACACTGAAAATCAGCA GAGTGGAGGCTGAGGATGTTGGGG TTTATTATTGCATGCAAGGTCTACA AATTCCGCTCACTTTCGGCGGAGG GACCAAAGTGGATATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1771 | CAGGTGCAGCTGCAGGAGTCGGGGG GAGGCTTGGTACAGCCTGGGGGGTC CCTGAGACTCTCCTGTGCAGCCTCTG GATTCACCTTTAGCAGCTATGCCATG AGCTGGGTCCGCCAGGCTCCAGGGA AGGGGCTGGAGTGGGTCTCAGCTATT AGTGGTAGTGGTGGTAGCACATACT ACGCAGACTCCGTGAAGGGCCGGTT CACCATCTCCAGAGACAATTCCAAG AACACGCTGTATCTGCAAATGAACA GCCTGAGAGCCGAGGACACGGCCGT ATATTACTGTGCGAAAGGAGGAATG TATTACTATGGTTCGGGGAGCTCGTA | SEQ ID 1879 | GATATTGTGATGACCCACACTCCA CTCTCTCTGTCCGTCACCCCTGGAC AGCCGGCCTCCATCTCCTGCAAGTC TAGTCAGAGCCTCCTGCATAGTGA TGGAAAGACCTATTTGTATTGGTAC CTGCAGAAGCCAGGCCAGCCTCCA CAGCTCCTGATCTATGAAGTTTCCA ACCGGTTCTCTGGAGTGCCAGATA GGTTCAGTGGCAGCGGGTCAGGGA CAGATTTCACACTGAAAATCAGCC GGGTGGAGGCTGAGGATGTTGGGG TTTATTACTGCATGCAAAGTATACA GCTTCCGTGGACGTTCGGCCAAGG |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CTTTGACTACTGGGGCCAGGGAACCC<br>TGGTGACCGTCTCCTCAGCATCCACC<br>AAGGGGCCTTCCGTGTTCCCCCTGGC<br>CCCTTCATCCAAGTCGACCTCTGGTG<br>GAACCGCCGCACTCGGTTGCCTGGTC<br>AAAGACTACTTCCCCGAGCCCGTGAC<br>TGTCTCGTGGAACTCGGGCGCCCTCA<br>CATCCGGAGTGCATACCTTTCCCGCC<br>GTGTTGCAGTCCAGCGGCCTGTACAG<br>CCTGAGCTCCGTCGTGACAGTGCCGT<br>CCTCCTCCCTTGGAACCCAGACCTAT<br>ATCTGCAACGTCAATCACAAGCCCTC<br>CAACACCAAAGTGGACAAGAAGGTC<br>GAACCCAAGTCCTGCGACAAGACTC<br>ACACCTGTCCGCCTTGTCCAGCCCCT<br>GAGCTGCTGGGTGGTCCGTCCGTGTT<br>CCTCTTCCCGCCCAAGCCGAAGGACA<br>CTCTGATGATTTCACGCACCCCGGAA<br>GTCACTTGCGTGGTCGTGGACGTGTC<br>GCACGAAGATCCCGAAGTGAAATTC<br>AATTGGTACGTGGATGGGGTCGAAG<br>TGCACAACGCCAAGACCAAGCCTAG<br>GGAAGAACAGTACAACTCTACGTAC<br>CGGGTGGTGTCCGTGCTGACCGTGCT<br>GCACCAGGACTGGCTGAACGGAAAG<br>GAGTACAAGTGCAAAGTGTCAAACA<br>AGGCTCTCCCTGCCCCTATCGAAAAG<br>ACCATCAGCAAGGCCAAGGGTCAAC<br>CTAGGGAGCCCCAGGTCTATACTTTG<br>CCGCCTAGCCGGGAAGAAATGACTA<br>AGAACCAAGTGTCCCTGACTTGCCTT<br>GTCAAGGGCTTTTATCCGTCCGACAT<br>CGCCGTGGAGTGGGAGTCCAACGGA<br>CAACCGGAGAACAACTACAAGACCA<br>CCCCACCGGTGCTCGATTCCGATGGC<br>TCCTTCTTCCTGTACTCCAAGCTGAC<br>TGTGGACAAGTCAAGATGGCAGCAG<br>GGAAACGTGTTCTCCTGCTCCGTGAT<br>GCACGAAGCGCTGCACAACCATTAC<br>ACCCAGAAATCACTGTCACTTTCGCC<br>GGGAAAA | | GACCAAGGTGGAGATCAAACGTAC<br>TGTGGCTGCTCCCTCCGTGTTCATT<br>TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |
| SEQ ID 1772 | CAGGTGCAGCTGGTGCAATCTGGGG<br>GAGGCTTGGTACAGCCTGGGGGGTC<br>CCTGAGACTCTCCTGTGCAGCCTCTG<br>GATTCACCTTTAGCAGCTATGCCATG<br>AGCTGGGTCCGCCAGGCTCCAGGGA<br>AGGGGCTGGAATGGGTCTCAGGTAT<br>TAGTGGTAGTGGTGGTAGCACATACT<br>ACGCAGACTCCGTGAAGGGCCGGTT<br>CACCATCTCCAGAGACAATTCCAAG<br>AACATGCTGTTTCTGCAAATGAACAG<br>CCCGAGAGCCGAGGACACGGCCGTA<br>TATTACTGTGCGAAGAAAATAGCAG<br>CAGCTGGTAAGCAACCTGTTGACTAC<br>TGGGGCCAGGGAACCCTGGTCACCG<br>TCTCCTCAGCATCCACCAAGGGGCCT<br>TCCGTGTTCCCCCTGGCCCCTTCATC<br>CAAGTCGACCTCTGGTGGAACCGCC<br>GCACTCGGTTGCCTGGTCAAAGACTA<br>CTTCCCCGAGCCCGTGACTGTCTCGT<br>GGAACTCGGGCGCCCTCACATCCGG<br>AGTGCATACCTTTCCCGCCGTGTTGC<br>AGTCCAGCGGCCTGTACAGCCTGAG<br>CTCCGTCGTGACAGTGCCGTCCTCCT<br>CCCTTGGAACCCAGACCTATATCTGC<br>AACGTCAATCACAAGCCCTCCAACA<br>CCAAAGTGGACAAGAAGGTCGAACC<br>CAAGTCCTGCGACAAGACTCACACCT<br>GTCCGCCTTGTCCAGCCCCTGAGCTG<br>CTGGGTGGTCCGTCCGTGTTCCTCTT<br>CCCGCCCAAGCCGAAGGACACTCTG<br>ATGATTTCACGCACCCCGGAAGTCAC<br>TTGCGTGGTCGTGGACGTGTCGCACG<br>AAGATCCCGAAGTGAAATTCAATTG | SEQ ID 1880 | GAAACGACACTCACGCAGTCTCCA<br>GCCACCCTGTCTGTGTCTCCAGGGG<br>AAAGAGCCACCCTCTCCTGCAGGG<br>CCAGTCAGAGTGTTAGCAGCAACT<br>TAGCCTGGTACCAGCAGAAACCTG<br>GCCAGGCTCCCAGGCTCCTCATCTA<br>TGGTGCATCCACCAGGGCCACTGG<br>CATCCCAGCCAGGTTCAGTGGCAG<br>TGGGTCTGGGACAGAGTTCACTCT<br>CACCATCAGCAGCCTGCAGTCTGA<br>AGATTTTGCAGTTTATTACTGTCAG<br>CAGTATAATAACTGGCCTCGGTTC<br>GGCCAAGGGACACGACTGGAGATT<br>AAACGTACTGTGGCTGCTCCCTCCG<br>TGTTCATTTTTCCTCCGTCGGACGA<br>ACAGCTGAAGTCCGGAACCGCGTC<br>CGTGGTCTGTCTCCTGAACAACTTC<br>TATCCGCGCGAGGCGAAAGTGCAG<br>TGGAAGGTCGACAACGCACTGCAG<br>TCGGGAAACTCCCAGGAATCGGTG<br>ACCGAGCAGGACTCGAAGGACTCA<br>ACCTACTCATTGTCCTCCACCCTCA<br>CCCTGAGCAAGGCCGATTACGAGA<br>AGCATAAGGTCTACGCCTGCGAAG<br>TGACCCACCAGGGCCTGAGCAGCC<br>CAGTGACGAAGTCCTTCAACCGGG<br>GAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GTACGTGGATGGGGTCGAAGTGCAC<br>AACGCCAAGACCAAGCCTAGGGAAG<br>AACAGTACAACTCTACGTACCGGGT<br>GGTGTCCGTGCTGACCGTGCTGCACC<br>AGGACTGGCTGAACGGAAAGGAGTA<br>CAAGTGCAAAGTGTCAAACAAGGCT<br>CTCCCTGCCCCTATCGAAAAGACCAT<br>CAGCAAGGCCAAGGGTCAACCTAGG<br>GAGCCCCAGGTCTATACTTTGCCGCC<br>TAGCCGGGAAGAAATGACTAAGAAC<br>CAAGTGTCCCTGACTTGCCTTGTCAA<br>GGGCTTTTATCCGTCCGACATCGCCG<br>TGGAGTGGGAGTCCAACGGACAACC<br>GGAGAACAACTACAAGACCACCCCA<br>CCGGTGCTCGATTCCGATGGCTCCTT<br>CTTCCTGTACTCCAAGCTGACTGTGG<br>ACAAGTCAAGATGGCAGCAGGGAAA<br>CGTGTTCTCCTGCTCCGTGATGCACG<br>AAGCGCTGCACAACCATTACACCCA<br>GAAATCACTGTCACTTTCGCCGGGAA<br>AA | | |
| SEQ ID 1773 | CAGGTGCAGCTACAGCAGTGGGGCG<br>CAGGACTGTTGAAGCCTTCGGAGAC<br>CCTGTCCCTCACCTGCGCTGTCTATG<br>GTGGGTCCTTCAGTGGTTACTACTGG<br>AGCTGGATCCGCCAGCCCCCAGGGA<br>AGGGGCTGGAGTGGATTGGGGAAAT<br>CAATCATAGTGGAAGCACCAACTAC<br>AACCCGTCCCTCAAGAGTCGAGTCAC<br>CATATCAGTAGACACGTCCAAGAAC<br>CAGTTCTCCCTGAAGCTGAGCTCTGT<br>GACCGCCGCGGACACGGCTGTGTATT<br>ACTGTGCGAGAAGGAAGGTGTATGA<br>TTACGTTTGGGGGAGTTATCGCCTCC<br>CCGGGTCGGTATCGTACTACTTTGAC<br>TACTGGGGCCAGGGAACCCTGGTCA<br>CCGTCTCCTCAGCATCCACCAAGGGG<br>CCTTCCGTGTTCCCCCTGGCCCCTTC<br>ATCCAAGTCGACCTCTGGTGGAACCG<br>CCGCACTCGGTTGCCTGGTCAAAGAC<br>TACTTCCCCGAGCCCGTGACTGTCTC<br>GTGGAACTCGGGCGCCCTCACATCCG<br>GAGTGCATACCTTTCCCGCCGTGTTG<br>CAGTCCAGCGGCCTGTACAGCCTGA<br>GCTCCGTCGTGACAGTGCCGTCCTCC<br>TCCCTTGGAACCCAGACCTATATCTG<br>CAACGTCAATCACAAGCCCTCCAAC<br>ACCAAAGTGGACAAGAAGGTCGAAC<br>CCAAGTCCTGCGACAAGACTCACAC<br>CTGTCCGCCTTGTCCAGCCCCTGAGC<br>TGCTGGGTGGTCCGTCCGTGTTCCTC<br>TTCCCGCCCAAGCCGAAGGACACTCT<br>GATGATTTCACGCACCCCGGAAGTCA<br>CTTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC<br>CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA | SEQ ID 1881 | GATGTTGTGATGACTCAGTCTCCTT<br>CCACCCTGTCTGCATCTGTAGGGG<br>ACAGAGTCACCATCACTTGCCGGG<br>CCAGTCAGACTATTAATAGTTGGTT<br>GGCCTGGTATCAGCAGAAACCAGG<br>GAAGGCCCCTAAGCTCCTCATCTCT<br>AGGGCGTCTCGTTTAGAAAGTGGG<br>GTCCCATCAAGGTTCAGCGGCAGT<br>GCATCTGGCACAGAATACATTCTC<br>ACCATCAACAGCCTGCAGCCTGAT<br>GATTTTGCAATGTACTTCTGCCATC<br>AATATAATAGTTATTCTCCCACTTT<br>TGGCCAGGGGACCAAGCTGGAGAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ACGTGTTCTCCTGCTCCGTGATGCAC<br>GAAGCGCTGCACAACCATTACACCC<br>AGAAATCACTGTCACTTTCGCCGGGA<br>AAA | | |
| SEQ ID<br>1774 | CAGGTCCAGCTGGTACAGTCTGGAG<br>CAGAGGTGAAAAAGCCCGGGGAGTC<br>TCTGAAGATCTCCTGTAAGGGTTCTG<br>GATACAGCTTTACCAGCTACTGGATC<br>GGCTGGGTGCGCCAGATGCCCGGGA<br>AAGGCCTGGAGTGGATGGGGATCAT<br>CTATCCTGGTGACTCTGATACCAGAT<br>ACAGCCCGTCCTTCCAAGGCCAGGTC<br>ACCATCTCAGCCGACAAGTCCATCAG<br>CACCGCCTACCTGCAGTGGAGCAGC<br>CTGAAGGCCTCGGACACCGCCATGT<br>ATTACTGTGCGAGACTCCCGGGGAG<br>AGCAGCTCGTCCAGACTACTGGGGC<br>CAGGGCACCCTGGTCACCGTCTCCTC<br>AGCACTCCACCAAGGGGCCTTCCGTGT<br>TCCCCCTGGCCCCTTCATCCAAGTCG<br>ACCTCTGGTGGAACCGCCGCACTCGG<br>TTGCCTGGTCAAAGACTACTTCCCCG<br>AGCCCGTGACTGTCTCGTGGAACTCG<br>GGCGCCCTCACATCCGGAGTGCATAC<br>CTTTCCCGCCGTGTTGCAGTCCAGCG<br>GCCTGTACAGCCTGAGCTCCGTCGTG<br>ACAGTGCCGTCCTCCTCCCTTGGAAC<br>CCAGACCTATATCTGCAACGTCAATC<br>ACAAGCCCTCCAACACCAAAGTGGA<br>CAAGAAGGTCGAACCCAAGTCCTGC<br>GACAAGACTCACACCTGTCCGCCTTG<br>TCCAGCCCCTGAGCTGCTGGGTGGTC<br>CGTCCGTGTTCCTCTTCCCGCCCAAG<br>CCGAAGGACACTCTGATGATTTCACG<br>CACCCCGGAAGTCACTTGCGTGGTCG<br>TGGACGTGTCGCACGAAGATCCCGA<br>AGTGAAATTCAATTGGTACGTGGATG<br>GGGTCGAAGTGCACAACGCCAAGAC<br>CAAGCCTAGGGAAGAACAGTACAAC<br>TCTACGTACCGGGTGGTGTCCGTGCT<br>GACCGTGCTGCACCAGGACTGGCTG<br>AACGGAAAGGAGTACAAGTGCAAAG<br>TGTCAAACAAGGCTCTCCCTGCCCCT<br>ATCGAAAAGACCATCAGCAAGGCCA<br>AGGGTCAACCTAGGGAGCCCCAGGT<br>CTATACTTTGCCGCCTAGCCGGGAAG<br>AAATGACTAAGAACCAAGTGTCCCT<br>GACTTGCCTTGTCAAGGGCTTTTATC<br>CGTCCGACATCGCCGTGGAGTGGGA<br>GTCAACGGACAACCGGAGAACAAC<br>TACAAGACCACCCCACCGGTGCTCG<br>ATTCCGATGGCTCCTTCTTCCTGTACT<br>CCAAGCTGACTGTGGACAAGTCAAG<br>ATGGCAGCAGGGAAACGTGTTCTCCT<br>GCTCCGTGATGCACGAAGCGCTGCA<br>CAACCATTACACCCAGAAATCACTGT<br>CACTTTCGCCGGGAAAA | SEQ ID<br>1882 | GAAACGACACTCACGCAGTCTCCA<br>GGCACCCTGTCTTTGTCTCCAGGGG<br>AAAGAGCCACCCTCTCCTGCAGGG<br>CCAGTCAGAGTGTTAGCAGCAGCT<br>ACTTAGCCTGGTACCAGCAGAAAC<br>CTGGCCAGGCTCCCAGGCTCCTCAT<br>CTATGGTGCATCCAGCAGGGCCAC<br>TGGCATCCCAGCCAGGTTCAGTGG<br>CAGTGGGTCTGGGACAGACTTCAC<br>TCTCACCATCAGCAGCCTAGAGCC<br>TGAAGATTTTGCAGTTTATTACTGT<br>CAGCAGCGTTACAACTGGCCTATC<br>ACCTTCGGCCAAGGGACACGACTG<br>GAGATTAAACGTACTGTGGCTGCT<br>CCCTCCGTGTTCATTTTTCCTCCGT<br>CGGACGAACAGCTGAAGTCCGGAA<br>CCGCGTCCGTGGTCTGTCTCCTGAA<br>CAACTTCTATCCGCGCGAGGCGAA<br>AGTGCAGTGGAAGGTCGACAACGC<br>ACTGCAGTCGGGAAACTCCCAGGA<br>ATCGGTGACCGAGCAGGACTGAAA<br>GGACTCAACCTACTCATTGTCCTCC<br>ACCCTCACCCTGAGCAAGGCCGAT<br>TACGAGAAGCATAAGGTCTACGCC<br>TGCGAAGTGACCCACCAGGGCCTG<br>AGCAGCCCAGTGACGAAGTCCTTC<br>AACCGGGGAGAATGC |
| SEQ ID<br>1775 | CAGGTCACCTTGAAGGAGTCTGGGG<br>GAGGCGTGGTCCAGCCTGGGAGGTC<br>CCTGAGACTCTCCTGTGCAGCCTCTG<br>GATTCACCTTCAGTAGCTATGCTATG<br>CACTGGGTCCGCCAGGCTCCAGGCA<br>AGGGGCTGGAGTGGGTGGCAGTTAT<br>ATCATATGATGGAAGTAATAAATACT<br>ACGCAGACTCCGTGAAGGGCCGATT<br>CACCATCTCCAGAGACAATTCCAAG<br>AACACGCTGTATCTGCAAATGAACA<br>GCCTGAGAGCTGAGGACACGGCTGT<br>GTATTACTGTGCGAGAGGCCCCGGG<br>GCAGTGGCTGGTACTAAGCCAAAGT<br>ACTACTTTGACTACTGGGGCCAGGGA<br>ACCCTGGTCACCGTCTCCTCAGCATC<br>CACCAAGGGGCCTTCCGTGTTCCCCC | SEQ ID<br>1883 | GAAATTGTGTTGACGCAGTCTCCA<br>GCCACCCTGTCTTTGTCTCCGGGGG<br>AAACAGCCACCCTCTCCTGCAGGG<br>CCAGTCAGACTATTGGTCCCAAGT<br>CCTTCGGCTGGTACCAACAGAGAC<br>CTGGCCAGGCTCCCAGGCTCCTCAT<br>CTATGACTCCAACAGGGCCACTGG<br>CATCCCAGCCAGGTTCAGTGGCAG<br>TGGGTCTGGGACAGACTTCACTCTC<br>ACCATCAGCAGCCTAGAGCCTGAA<br>GATTTTGCAGTTTATTACTGTCAGC<br>AGCGTAGCAGGTGGCCTCTCACTTT<br>CGGCCCTGGGACCAAAGTGGATAT<br>CAAACGTACTGTGGCTGCTCCCTCC<br>GTGTTCATTTTTCCTCCGTCGGACG<br>AACAGCTGAAGTCCGGAACCGCGT |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
|  | TGGCCCCTTCATCCAAGTCGACCTCT GGTGGAACCGCCGCACTCGGTTGCCT GGTCAAAGACTACTTCCCCGAGCCCG TGACTGTCTCGTGGAACTCGGGCGCC CTCACATCCGGAGTGCATACCTTTCC CGCCGTGTTGCAGTCCAGCGGCCTGT ACAGCCTGAGCTCCGTCGTGACAGTG CCGTCCTCCTCCCTTGGAACCCAGAC CTATATCTGCAACGTCAATCACAAGC CCTCCAACACCAAAGTGGACAAGAA GGTCGAACCCAAGTCCTGCGACAAG ACTCACACCTGTCCGCCTTGTCCAGC CCCTGAGCTGCTGGGTGGTCCGTCCG TGTTCCTCTTCCCGCCCAAGCCGAAG GACACTCTGATGATTTCACGCACCCC GGAAGTCACTTGCGTGGTCGTGGAC GTGTCGCACGAAGATCCCGAAGTGA AATTCAATTGGTACGTGGATGGGGTC GAAGTGCACAACGCCAAGACCAAGC CTAGGGAAGAACAGTACAACTCTAC GTACCGGGTGGTGTCCGTGCTGACCG TGCTGCACCAGGACTGGCTGAACGG AAAGGAGTACAAGTGCAAAGTGTCA AACAAGGCTCTCCCTGCCCCTATCGA AAAGACCATCAGCAAGGCCAAGGGT CAACCTAGGGAGCCCCAGGTCTATA CTTTGCCGCCTAGCCGGGAAGAAAT GACTAAGAACCAAGTGTCCCTGACTT GCCTTGTCAAGGGCTTTTATCCGTCC GACATCGCCGTGGAGTGGGAGTCCA ACGGACAACCGGAGAACAACTACAA GACCACCCCACCGGTGCTCGATTCCG ATGGCTCCTTCTTCCTGTACTCCAAG CTGACTGTGGACAAGTCAAGATGGC AGCAGGGAAACGTGTTCTCCTGCTCC GTGATGCACGAAGCGCTGCACAACC ATTACACCCAGAAATCACTGTCACTT TCGCCGGGAAAA |  | CCGTGGTCTGTCTCCTGAACAACTT CTATCCGCGCGAGGCGAAAGTGCA GTGGAAGGTCGACAACGCACTGCA GTCGGGAAACTCCCAGGAATCGGT GACCGAGCAGGACTCGAAGGACTC AACCTACTCATTGTCCTCCACCCTC ACCCTGAGCAAGGCCGATTACGAG AAGCATAAGGTCTACGCCTGCGAA GTGACCCACCAGGGCCTGAGCAGC CCAGTGACGAAGTCCTTCAACCGG GGAGAATGC |
| SEQ ID 1776 | GAGGTCCAGCTGGTGCAGTCTGGGG GAGGCGTGGTCCAGCCTGGGAGGTC CCTGAGACTCTCCTGTGCAGCCTCTG GATTCACCTTCAGTAGCTATGCTATG CACTGGGTCCGCCAGGCTCCAGGCA AGGGGCTGGAGTGGGTGGCAGTTAT ATCATATGATGGAAGTAATAAATACT ACGCAGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCGAGGGCCACGTATT ACTATGATAGTAGTGGTTATAGGTTT GACTACTGGGGCCAGGGAACCCTGG TCACCGTCTCCTCAGCATCCACCAAG GGGCCTTCCGTGTTCCCCCTGGCCCC TTCATCCAAGTCGACCTCTGGTGGAA CCGCCGCACTCGGTTGCCTGGTCAAA GACTACTTCCCCGAGCCCGTGACTGT CTCGTGGAACTCGGGCGCCCTCACAT CCGGAGTGCATACCTTTCCCGCCGTG TTGCAGTCCAGCGGCCTGTACAGCCT GAGCTCCGTCGTGACAGTGCCGTCCT CCTCCCTTGGAACCCAGACCTATATC TGCAACGTCAATCACAAGCCCTCCAA CACCAAAGTGGACAAGAAGGTCGAA CCCAAGTCCTGCGACAAGACTCACA CCTGTCCGCCTTGTCCAGCCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG | SEQ ID 1884 | GATGTTGTGATGACTCAGTCTCCAC TCTCCCTGCCCGTCACCCTTGGACA GCCGGCCTCCATCTCCTGCAGGTCT AGTCAAAGCCTCGTGTACAGTGAT GGAAACACCTACTTGTATTGGTTTC AGCAGAGGGCAGGCCAATCTCCAA GGCGCCTGATTTATAAGGTTTCTAA GCGGGACTCTGGGGTCCCAGACAG GTTCAGCGGCAGTGGGTCAGGCAC TGATTTCACACTGAAAATCAGCAG GGTGGAGGCTGAGGATGTTGGAAT TTATTACTGCGTGCAAGGTAGACA CTGGCCGTACACTCTTGGCCAGGG GACCAAGCTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | | |
| SEQ ID 1777 | GAGGTCCAGCTGGTACAGTCTGGGG GAGGCTTGGTAGAACCGGGGGGGTC CCTTAGACTCTCCTGTGCAGCCTCTC GATTCACTTTCAGTGACGCCTGGATG AGCTGGGTCCGCCAGGCTCCAGGTA AGGGGCTGGAGTGGGTTGGCCGTAT TAAAAGCAAAATAAGTGGTGGGACA ACAGACTACGCTGCACCCGTGCAAG GCAGATTCACCATCTCAAGAGATGAT TCAAAAAACACGCTGTATCTGCAAAT GGACAGCCTGAAAACCGAGGACACA GCCGTGTATTACTGTGCGAACCGAAA CTTAGGCTACTGGGGCCAGGGCACC CTGGTGACCGTCTCCTCAGCATCCAC CAAGGGGCCTTCCGTGTTCCCCCTGG CCCCTTCATCCAAGTCGACCTCTGGT GGAACCGCCGCACTCGGTTGCCTGGT CAAAGACTACTTCCCCGAGCCCGTGA CTGTCTCGTGGAACTCGGGCGCCCTC ACATCCGGAGTGCATACCTTTCCCGC CGTGTTGCAGTCCAGCGGCCTGTACA GCCTGAGCTCCGTCGTGACAGTGCCG TCCTCCTCCCTTGGAACCCAGACCTA TATCTGCAACGTCAATCACAAGCCCT CCAACACCAAAGTGGACAAGAAGGT CGAACCCAAGTCCTGCGACAAGACT CACACCTGTCCGCCTTGTCCAGCCCC TGAGCTGCTGGGTGGTCCGTCCGTGT TCCTCTTCCCGCCCAAGCCGAAGGAC ACTCTGATGATTTCACGCACCCCGGA AGTCACTTGCGTGGTCGTGGACGTGT CGCACGAAGATCCCGAAGTGAAATT CAATTGGTACGTGGATGGGGTCGAA GTGCACAACGCCAAGACCAAGCCTA GGGAAGAACAGTACAACTCTACGTA CCGGGTGGTGTCCGTGCTGACCGTGC TGCACCAGGACTGGCTGAACGGAAA GGAGTACAAGTGCAAAGTGTCAAAC AAGGCTCTCCCTGCCCCTATCGAAAA GACCATCAGCAAGGCCAAGGGTCAA CCTAGGGAGCCCCAGGTCTATACTTT GCCGCCTAGCCGGGAAGAAATGACT AAGAACCAAGTGTCCCTGACTTGCCT TGTCAAGGGCTTTTATCCGTCCGACA TCGCCGTGGAGTGGGAGTCCAACGG ACAACCGGAGAACAACTACAAGACC ACCCCACCGGTGCTCGATTCCGATGG CTCCTTCTTCCTGTACTCCAAGCTGA CTGTGGACAAGTCAAGATGGCAGCA GGGAAACGTGTTCTCCTGCTCCGTGA TGCACGAAGCGCTGCACAACCATTA CACCCAGAAATCACTGTCACTTTCGC CGGGAAAA | SEQ ID 1885 | GAAATTGTGTTGACGCAGTCTCCA GGCACCCTGTCTTTGTCTCCAGGGG AAAGAGCCACCCTCTCCTGCAGGG CCAGTCAGAGTGTTAGCAGCAGCT ACTTAGCCTGGTACCAGCAGAAAC CTGGCCAGGCTCCCAGGCTCCTCAT CTATGATGCATCCAACAGGGCCAC TGGCATCCCAGCCAGGTTCAGTGG CAGTGGATCTGGGACAGAATTCAC TCTCACCATCAGCAGCCTGCAGCCT GATGATTTTGCAACTTATTACTGCC AACAGTATAATAGTTATTCAAGGA CGTTCGGCCAGGGGACCAAAGTGG ATATCAAACGTACTGTGGCTGCTCC CTCCGTGTTCATTTTTCCTCCGTCG GACGAACAGCTGAAGTCCGGAACC GCGTCCGTGGTCTGTCTCCTGAACA ACTTCTATCCGCGCGAGGCGAAAG TGCAGTGGAAGGTCGACAACGCAC TGCAGTCGGGAAACTCCCAGGAAT CGGTGACCGAGCAGGACTCGAAGG ACTCAACCTACTCATTGTCCTCCAC CCTCACCCTGAGCAAGGCCGATTA CGAGAAGCATAAGGTCTACGCCTG CGAAGTGACCCACCAGGGCCTGAG CAGCCCCAGTGACGAAGTCCTTCAA CCGGGGAGAATGC |
| SEQ ID 1778 | GAGGTCCAGCTGGTGCAGTCTGGGG CTGAGGTGAAGAAGCCTGGGGCCTC | SEQ ID 1886 | GATGTTGTGATGACTCAGTCTCCTT CCACCCTGTCTGCATCTGTGGGAG |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | AGTGAAGGTTTCCTGCAAGGCTTCTG<br>GATACACCTTCACTAGCTATGCTATG<br>CATTGGGTGCGCCAGGCCCCCGGAC<br>AAAGGCTTGAGTGGATGGGATGGAT<br>CAACGCTGGCAATGGTAACACAAAA<br>TATTCACAGAAGTTCCAGGGCAGAG<br>TCACCATGACCACAGACACATCCAC<br>GAGCACAGCCTACATGGAGCTGAGG<br>AGCCTGAGATCTGACGACACGGCCG<br>TGTATTACTGTGCGAGAGCTCGTTAC<br>TATGATAGTAGTGGTTATATTGCCCC<br>ATCGGGTTACTTTGACTACTGGGGCC<br>AGGGAACCCTGGTCACCGTCTCCTCA<br>GCATCCACCAAGGGGCCTTCCGTGTT<br>CCCCCTGGCCCCTTCATCCAAGTCGA<br>CCTCTGGTGGAACCGCCGCACTCGGT<br>TGCCTGGTCAAAGACTACTTCCCCGA<br>GCCCGTGACTGTCTCGTGGAACTCGG<br>GCGCCCTCACATCCGGAGTGCATACC<br>TTTCCCGCCGTGTTGCAGTCCAGCGG<br>CCTGTACAGCCTGAGCTCCGTCGTGA<br>CAGTGCCGTCCTCCTCCCTTGGAACC<br>CAGACCTATATCTGCAACGTCAATCA<br>CAAGCCCTCCAACACCAAAGTGGAC<br>AAGAAGGTCGAACCCAAGTCCTGCG<br>ACAAGACTCACACCTGTCCGCCTTGT<br>CCAGCCCCTGAGCTGCTGGGTGGTCC<br>GTCCGTGTTCCTCTTCCCGCCCAAGC<br>CGAAGGACACTCTGATGATTTCACGC<br>ACCCCGGAAGTCACTTGCGTGGTCGT<br>GGACGTGTCGCACGAAGATCCCGAA<br>GTGAAATTCAATTGGTACGTGGATGG<br>GGTCGAAGTGCACAACGCCAAGACC<br>AAGCCTAGGGAAGAACAGTACAACT<br>CTACGTACCGGGTGGTGTCCGTGCTG<br>ACCGTGCTGCACCAGGACTGGCTGA<br>ACGGAAAGGAGTACAAGTGCAAAGT<br>GTCAAACAAGGCTCTCCCTGCCCCTA<br>TCGAAAAGACCATCAGCAAGGCCAA<br>GGGTCAACCTAGGGAGCCCCAGGTC<br>TATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | ACAGAGTCACCATCACTTGCCGGG<br>CCAGTCAGAGTATTACTACCTGGTT<br>GGCCTGGTCTCAGCAGCAACCAGG<br>GAAAGCCCCTAAGCTCCTCATCTAT<br>AAGGCCTCTAGTTTAACAAGTGGG<br>GTCCCATCAAGGTTCAGCGGCAGT<br>GGATCTGGGACAGAGTTCACTCTC<br>ACCATCAGCAGCCTGCAGCCTGAT<br>GATTTTGCAAGTTATTACTGCCATC<br>ATTATAATGGTGCTTCTCGTATGTT<br>CGGCCAAGGGACCAAGCTGGAGAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCAAA<br>GTGACCCACCAGGGCCTGAGCAGC<br>CCAGTGACGAAGTCCTTCAACCGG<br>GGAGAATGC |
| SEQ ID 1779 | CAGGTGCAGCTGGTGCAGTCTGGGG<br>CTGAGGTGAAGAAGCCTGGGGCCTC<br>AGTGAAGGTTTCCTGCAAGGCTTCTG<br>GATACACCTTCACTAGCTATGCTATG<br>CATTGGGTGCGCCAGGCCCCCGGAC<br>AAAGGCTTGAGTGGATGGGATGGAT<br>CAACGCTGGCAATGGTAACACAAAA<br>TATTCACAGAAGTTCCAGGGCAGAG<br>TCACCATTACCAGGGACACATCCGCG<br>AGCACAGCCTACATGGAGCTGAGCA<br>GCCTGAGATCTGAAGACACGGCTGT<br>GTATTACTGTGCGAGAGATGGCCCCG<br>CCGTTGATGGTGCTGAATACTTCCAG<br>CACTGGGGCCAGGGCACCCTGGTCA<br>CCGTCTCCTCAGCATCCACCAAGGGG<br>CCTTCCGTGTTCCCCCTGGCCCCTTC<br>ATCCAAGTCGACCTCTGGTGGAACCG<br>CCGCACTCGGTTGCCTGGTCAAAGAC<br>TACTTCCCCGAGCCCGTGACTGTCTC<br>GTGGAACTCGGGCGCCCTCACATCCG<br>GAGTGCATACCTTTCCCGCCGTGTTG<br>CAGTCCAGCGGCCTGTACAGCCTGA | SEQ ID 1887 | GAAACGACACTCACGCAGTCTCCA<br>GCCACCCTGTCTTTGTCTCCAGGGG<br>AAAGAGCCACCCTCTCCTGCAGGG<br>CCAGTCAGAGTGTTAGCAGCTACT<br>TAGCCTGGTACCAACAGAAACCTG<br>GCCAGGCTCCCAGGCTCCTCATCTA<br>TGATGCATCCAACAGGGCCACTGG<br>CATCCCAGCCAGGTTCAGTGGCAG<br>TGGGTCTGGGACAGACTTCACTCTC<br>ACCATCAGCAGCCTAGAGCCTGAA<br>GATTTTGCAGTTTATTACTGTCAGC<br>AGCGTAGCAACTGGCCTTTCTTCGG<br>CCAAGGGACACGACTGGAGATTAA<br>ACGTACTGTGGCTGCTCCCTCCGTG<br>TTCATTTTTCCTCCGTCGGACGAAC<br>AGCTGAAGTCCGGAACCGCGTCCG<br>TGGTCTGTCTCCTGAACAACTTCTA<br>TCCGCGCGAGGCGAAAGTGCAGTG<br>GAAGGTCGACAACGCACTGCAGTC<br>GGGAAACTCCCAGGAATCGGTGAC<br>CGAGCAGGACTCGAAGGACTCAAC<br>CTACTCATTGTCCTCCACCCTCACC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | GCTCCGTCGTGACAGTGCCGTCCTCC<br>TCCCTTGGAACCCAGACCTATATCTG<br>CAACGTCAATCACAAGCCCTCCAAC<br>ACCAAAGTGGACAAGAAGGTCGAAC<br>CCAAGTCCTGCGACAAGACTCACAC<br>CTGTCCGCCTTGTCCAGCCCTGAGC<br>TGCTGGGTGGTCCGTCCGTGTTCCTC<br>TTCCCGCCCAAGCCGAAGGACACTCT<br>GATGATTTCACGCACCCCGGAAGTCA<br>CTTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC<br>CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA<br>ACGTGTTCTCCTGCTCCGTGATGCAC<br>GAAGCGCTGCACAACCATTACACCC<br>AGAAATCACTGTCACTTTCGCCGGGA<br>AAA | | CTGAGCAAGGCCGATTACGAGAAG<br>CATAAGGTCTACGCCTGCGAAGTG<br>ACCCACCAGGGCCTGAGCAGCCCA<br>GTGACGAAGTCCTTCAACCGGGGA<br>GAATGC |
| SEQ ID<br>1780 | CAGCTGCAGCTGCAGGAGTCGGGTC<br>CAGGACTGGTGAAGCCCTCGCAGAC<br>CCTCTCACTCACCTGTGCCATCTCCG<br>GGGACAGTGTCTCTAGCAACAGTGCT<br>GCTTGGAACTGGATCAGGCAGTCCCC<br>ATCGCGAGGCCTTGAGTGGCTGGGA<br>AGGACTTACTACAGGTCCAAGTGGT<br>ATAATGATTATGCAGTATCTCTGAAA<br>AGTCGAATAACCATCAACCCGGACA<br>CATCCAAGAACCAGTTCTCCCTGCAG<br>CTGAACTCTGTGACTCCCGAGGACAC<br>GGCTGTATATTACTGTGCAAGTTTGG<br>CGAGTGGTTCCCCCCCTCCGGGGGAC<br>TACTGGGGCCAGGGAACCCTGGTGA<br>CCGTCTCCTCAGCATCCACCAAGGGG<br>CCTTCCGTGTTCCCCCTGGCCCCTTC<br>ATCCAAGTCGACCTCTGGTGAACCG<br>CCGCACTCGGTTGCCTGGTCAAAGAC<br>TACTTCCCCGAGCCCGTGACTGTCTC<br>GTGGAACTCGGGCGCCCTCACATCCG<br>GAGTCATACCTTTCCCGCCGTGTTG<br>CAGTCCAGCGGCCTGTACAGCCTGA<br>GCTCCGTCGTGACAGTGCCGTCCTCC<br>TCCCTTGGAACCCAGACCTATATCTG<br>CAACGTCAATCACAAGCCCTCCAAC<br>ACCAAAGTGGACAAGAAGGTCGAAC<br>CCAAGTCCTGCGACAAGACTCACAC<br>CTGTCCGCCTTGTCCAGCCCTGAGC<br>TGCTGGGTGGTCCGTCCGTGTTCCTC<br>TTCCCGCCCAAGCCGAAGGACACTCT<br>GATGATTTCACGCACCCCGGAAGTCA<br>CTTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGAA<br>GAACAGTACAACTCTACGTACCGGG<br>TGGTGTCCGTGCTGACCGTGCTGCAC<br>CAGGACTGGCTGAACGGAAAGGAGT<br>ACAAGTGCAAAGTGTCAAACAAGGC<br>TCTCCCTGCCCCTATCGAAAAGACCA<br>TCAGCAAGGCCAAGGGTCAACCTAG<br>GGAGCCCCAGGTCTATACTTTGCCGC | SEQ ID<br>1888 | GAAACGACACTCACGCAGTCTCCA<br>GCCACCCTGACTTTGTCTCCAGGGG<br>AAAGAGTCACCCTCTCCTGCAGGG<br>CCAGTCAGAGTATTGGCACTTACG<br>TCGCCTGGTATCAGCAGAAACCTG<br>GCCAGGCTCCCAGATTCCTCATCTA<br>TGATTCATCGAATAGGGCCACTGG<br>CATCCCAGCCAGGTTCAGTGGTAG<br>TGGGTCTGGGACAGACTTCACTCTC<br>ACGATCAGCAGCCTGGAGCCTGAA<br>GATTTTGCATTTTATTACTGTCAAC<br>AGCGTGCCGAGTGGCCTCTCACCTT<br>CGGCCAAGGGACACGACTGGAGAT<br>TAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CTAGCCGGGAAGAAATGACTAAGAA<br>CCAAGTGTCCCTGACTTGCCTTGTCA<br>AGGGCTTTTATCCGTCCGACATCGCC<br>GTGGAGTGGGAGTCCAACGGACAAC<br>CGGAGAACAACTACAAGACCACCCC<br>ACCGGTGCTCGATTCCGATGGCTCCT<br>TCTTCCTGTACTCCAAGCTGACTGTG<br>GACAAGTCAAGATGGCAGCAGGGAA<br>ACGTGTTCTCCTGCTCCGTGATGCAC<br>GAAGCGCTGCACAACCATTACACCC<br>AGAAATCACTGTCACTTTCGCCGGGA<br>AAA | | |
| SEQ ID<br>1781 | CAGGTCACCTTGAAGGAGTCTGGGG<br>GAGGCGTGGTCCAGCCTGGGAGGTC<br>CCTGAGACTCTCCTGTGCAGCCTCTG<br>GATTCACCTTCAGTACCTATGGCATG<br>CACTGGGTCCGCCAGGCTCCAGGCA<br>AGGGGCTGGAGTGGGTGGCACTTAT<br>ATCATATGATGGAAGTAAAAAATAC<br>TATGCAAACTCCGTGAAGGGCCGATT<br>CACCATCTCCAGAGACAATTCCAAG<br>AACACGTTGTATCTGCAAATGAAAA<br>GTCTGAGAGCTGAGGACACGGCTAT<br>GTATTACTGTGCGAAAGGCCCTATAG<br>TGGGAGCGACTATGGACTACTGGGG<br>CCAGGGAGCCCTGGTCACCGTCTCCT<br>CAGCATCCACCAAGGGGCCTTCCGTG<br>TTCCCCCTGGCCCCTTCATCCAAGTC<br>GACCTCTGGTGGAACCGCCGCACTCG<br>GTTGCCTGGTCAAAGACTACTTCCCC<br>GAGCCCGTGACTGTCTCGTGGAACTC<br>GGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | SEQ ID<br>1889 | GATGTTGTGATGACTCAGTCTCCAG<br>GCACCCTGTCTTTGTCTCCAGGGGA<br>AAGAGCCACTCTCTCCTGCAGGGC<br>CAGTCAGAGTGTTAATAGCGGCTA<br>CTTAGCCTGGTACCAGCAGAAACC<br>TGGCCAACCTCCCAGACTCCTCATC<br>TCTGGTGTTTCCACCAGGGCCACTG<br>GCATCCCAGACAGGTTCAGTGGCA<br>GTGGGTCTGGGACAGACTTCACTC<br>TCACCATCAGCAGACTGGAGCCTG<br>AAGATTTTGCAGTGTATTACTGTCA<br>GGAGTATGGTAACTCAGCTATGTA<br>CAATTTTGGCCAGGGGACCAAGCT<br>GGAGATCAAACGTACTGTGGCTGC<br>TCCCTCCGTGTTCATTTTTCCTCCGT<br>CGGACGAACAGCTGAAGTCCGGAA<br>CCGCGTCCGTGGTCTGTCTCCTGAA<br>CAACTTCTATCCGCGCGAGGCGAA<br>AGTGCAGTGGAAGGTCGACAACGC<br>ACTGCAGTCGGGAAACTCCCAGGA<br>ATCGGTGACCGAGCAGGACTCGAA<br>GGACTCAACCTACTCATTGTCCTCC<br>ACCCTCACCCTGAGCAAGGCCGAT<br>TACGAGAAGCATAAGGTCTACGCC<br>TGCGAAGTGACCCACCAGGGCCTG<br>AGCAGCCCAGTGACGAAGTCCTTC<br>AACCGGGGAGAATGC |
| SEQ ID<br>1782 | GAGGTGCAGCTGGTGCAGTCTGGGG<br>CTGAGGTGAAGAAGCCTGGGTCCTC<br>GGTGAAGGTCTCCTGCAAGGCTTCTG<br>GAGGCACCTTCAGCAGCTATGCTATC<br>AGCTGGGTGCGACAGGCCCCTGGAC<br>AAGGGCTTGAGTGGATGGGATGGAT<br>CAGCGCTTACAATGGTAACACAAAC<br>TATGCACAGAAGCTCCAGGGCAGAG | SEQ ID<br>1890 | GAAACGACACTCACGCAGTCTCCA<br>GCCACCCTGTCTGTGTCTCCAGGGG<br>AAAAGAGCCACCCTCTCCTGCAGGG<br>CCAGTCAGAGTGTTAGCAGCAACT<br>TAGCCTGGTACCAGCAGAAACCTG<br>GCCAGGCTCCCAGGCTCCTCATCTA<br>TGGTGCATCCACCAGGGCCACTGG<br>TATCCCAGCCAGGTTCAGTGGCAG |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TCACCATGACCACAGACACATCCAC<br>GAGCACAGCCTACATGGAGCTGAGG<br>AGCCTGAGATCTGACGACACGGCCG<br>TGTATTACTGTGCGGATGGTACGGT<br>GACTACGGCCTTGACTACTGGGGCCA<br>GGGAACCCTGGTCACCGTCTCCTCAG<br>CATCCACCAAGGGGCCTTCCGTGTTC<br>CCCCTGGCCCCTTCATCCAAGTCGAC<br>CTCTGGTGGAACCGCCGCACTCGGTT<br>GCCTGGTCAAAGACTACTTCCCCGAG<br>CCCGTGACTGTCTCGTGGAACTCGGG<br>CGCCCTCACATCCGGAGTGCATACCT<br>TTCCCGCCGTGTTGCAGTCCAGCGGC<br>CTGTACAGCCTGAGCTCCGTCGTGAC<br>AGTGCCGTCCTCCTCCCTTGGAACCC<br>AGACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGTC<br>CAGCCCCTGAGCTGCTGGGTGGTCCG<br>TCCGTGTTCCTCTTCCCGCCCAAGCC<br>GAAGGACACTCTGATGATTTCACGCA<br>CCCCGGAAGTCACTTGCGTGGTCGTG<br>GACGTGTCGCACGAAGATCCCGAAG<br>TGAAATTCAATTGGTACGTGGATGGG<br>GTCGAAGTGCACAACGCCAAGACCA<br>AGCCTAGGGAAGAACAGTACAACTC<br>TACGTACCGGGTGGTGTCCGTGCTGA<br>CCGTGCTGCACCAGGACTGGCTGAA<br>CGGAAAGGAGTACAAGTGCAAAGTG<br>TCAAACAAGGCTCTCCCTGCCCCTAT<br>CGAAAAGACCATCAGCAAGGCCAAG<br>GGTCAACCTAGGGAGCCCCAGGTCT<br>ATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | TGGGTCTGGGACAGAGTTCACTCT<br>CACCATCAGCAGCCTGCAGTCTGA<br>AGATTTTGCAGTTTATTACTGTCAG<br>CAGTATAATAACTGGCCTCCCTTCA<br>CCTTCGGCCAAGGGACACGACTGG<br>AGATTAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |
| SEQ ID 1783 | GAGGTCCAGCTGGTGCAGTCTGGGG<br>CTGAGGTGAAGAAGCCTGGGGCCTC<br>AGTGAAGGTTTCCTGCAAGGCTTCTG<br>GATACACCTTCACTAGCTATGCTATG<br>CATTGGGTGCGCCAGGCCCCCGGAC<br>AAAGGCTTGCGTGGATGGGATGGAT<br>CAACGCTGGCAATGGTAACACAAAA<br>TATTCAGAGAAGTTCGAAGGCAGAG<br>TCACCATCACCAGGGACACATCCGC<br>GAGCACAGCCTACATGGAGCTGAGC<br>AGCCTGAGATCTGAAGACACGGCTG<br>TGTATTACTGTGCGAGGGTCGCCAAA<br>TATTATTACGAGAGTGGTGGTTATCG<br>GGCCTCCAACTGGTTCGACCCCTGGG<br>GCCAGGGCACCCTGGTCACCGTCTCC<br>TCAGCATCCACCAAGGGGCCTTCCGT<br>GTTCCCCCTGGCCCCTTCATCCAAGT<br>CGACCTCTGGTGGAACCGCCGCACTC<br>GGTTGCCTGGTCAAAGACTACTTCCC<br>CGAGCCCGTGACTGTCTCGTGGAACT<br>CGGGCGCCCTCACATCCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG | SEQ ID 1891 | GATGTTGTGATGACTCAGTCTCCAG<br>GCACCCTGTCTTTGTCTCCAGGGGA<br>AAGAGCCACCCTCTCCTGCAGGGC<br>CAGTCAGAGTGTTAGCAGCAGCTA<br>CTTAGGCTGGTATCAGCAGAAATC<br>CGGCCAGGCTCCCAGGCTCCTCAT<br>CTATGGTGCATCCAGCAGGGCCAC<br>TGACATCCCAGACAGGTTCAGTGG<br>CAGTGGGTCTGGGACAGACTTCAC<br>TCTCACCATCAGCAAACTGGAGGC<br>AGAAGATTCTGCAGTGTATTACTGT<br>CAGCAGTATGGTATCTCACCTCTCG<br>CGTTCGGCCAAGGGACCAAGCTGG<br>AGATCAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
|  | TCCGTCCGTGTTCCTCTTCCCGCCCA |  |  |
|  | AGCCGAAGGACACTCTGATGATTTCA |  |  |
|  | CGCACCCCGGAAGTCACTTGCGTGGT |  |  |
|  | CGTGGACGTGTCGCACGAAGATCCC |  |  |
|  | GAAGTGAAATTCAATTGGTACGTGG |  |  |
|  | ATGGGGTCGAAGTGCACAACGCCAA |  |  |
|  | GACCAAGCCTAGGGAAGAACAGTAC |  |  |
|  | AACTCTACGTACCGGGTGGTGTCCGT |  |  |
|  | GCTGACCGTGCTGCACCAGGACTGG |  |  |
|  | CTGAACGGAAAGGAGTACAAGTGCA |  |  |
|  | AAGTGTCAAACAAGGCTCTCCCTGCC |  |  |
|  | CCTATCGAAAAGACCATCAGCAAGG |  |  |
|  | CCAAGGGTCAACCTAGGGAGCCCCA |  |  |
|  | GGTCTATACTTTGCCGCCTAGCCGGG |  |  |
|  | AAGAAATGACTAAGAACCAAGTGTC |  |  |
|  | CCTGACTTGCCTTGTCAAGGGCTTTT |  |  |
|  | ATCCGTCCGACATCGCCGTGGAGTGG |  |  |
|  | GAGTCCAACGGACAACCGGAGAACA |  |  |
|  | ACTACAAGACCACCCCACCGGTGCTC |  |  |
|  | GATTCCGATGGCTCCTTCTTCCTGTA |  |  |
|  | CTCCAAGCTGACTGTGGACAAGTCA |  |  |
|  | AGATGGCAGCAGGGAAACGTGTTCT |  |  |
|  | CCTGCTCCGTGATGCACGAAGCGCTG |  |  |
|  | CACAACCATTACACCCAGAAATCACT |  |  |
|  | GTCACTTTCGCCGGGAAAA |  |  |
| SEQ ID 1784 | CAGGTGCAGCTGCAGGAGTCAGGTC | SEQ ID 1892 | GAAACGACACTCACGCAGTCTCCA |
|  | CAGGACTGGTGAAGCCCTCGCAGAC |  | GCCACCCTGTCTGTGTCTCCAGGGG |
|  | CCTCTCACTCACCTGTGCCATCTCCG |  | AGAGAGCCACCCTCTCCTGCAGGG |
|  | GGGACAGTGTCTCTAGCAACAGTGCT |  | CCAGTCAGAGTATTAGCAACAACT |
|  | GCTTGGAACTGGATCAGGCAGTCCCC |  | TAGCCTGGTACCAGCAGAAACCTG |
|  | ATCGAGAGGCCTTGAGTGGCTGGGA |  | GCCAGGCTCCCAGGCTCCTCATCTA |
|  | AGGACATACTACAGGTCCAAGTGGT |  | TGGTACATCCACCAGGGCCACTGG |
|  | ATAATGATTATGCAGTATCTGTGAAA |  | TATCCCAGCCAGGTTCAGTGGCAG |
|  | AGTCGAATAACCATCAACCCAGACA |  | TGGGTCTGGGACAGAGTTCACTCT |
|  | CATCCAAGAACCAGTTCTCCCTGCAG |  | CACCATCAGCAGCCTGCAGTCTGA |
|  | CTGAACTCTGTGACTCCCGAGGACAC |  | AGATTTTGCAGTTTATTACTGTCAG |
|  | GGCTGTGTATTACTGTGCAAGAGCGC |  | CAGTATAATTTCTGGCCTTCGATCA |
|  | CCCCTCCGACTGTTGGCTGGTACGCC |  | CCTTCGGCCAAGGGACACGACTGG |
|  | CCCGTCTTTGACTACTGGGGCCAGGG |  | AGATTAAACGTACTGTGGCTGCTC |
|  | AACCTGGTCACCGTCTCCTCAGCAT |  | CCTCCGTGTTCATTTTTCCTCCGTC |
|  | CCACCAAGGGGCCTTCCGTGTTCCCC |  | GGACGAACAGCTGAAGTCCGGAAC |
|  | CTGGCCCCTTCATCCAAGTCGACCTC |  | CGCGTCCGTGGTCTGTCTCCTGAAC |
|  | TGGTGGAACCGCCGCACTCGGTTGCC |  | AACTTCTATCCGCGCGAGGCGAAA |
|  | TGGTCAAAGACTACTTCCCCGAGCCC |  | GTGCAGTGGAAGGTCGACAACGCA |
|  | GTGACTGTCTCGTGGAACTCGGGCGC |  | CTGCAGTCGGGAAACTCCCAGGAA |
|  | CCTCACATCCGGAGTGCATACCTTTC |  | TCGGTGACCGAGCAGGACTCGAAG |
|  | CCGCCGTGTTGCAGTCCAGCGGCCTG |  | GACTCAACCTACTCATTGTCCTCCA |
|  | TACAGCCTGAGCTCCGTCGTGACAGT |  | CCCTCACCCTGAGCAAGGCCGATT |
|  | GCCGTCCTCCTCCCTTGGAACCCAGA |  | ACGAGAAGCATAAGGTCTACGCCT |
|  | CCTATATCTGCAACGTCAATCACAAG |  | GCGAAGTGACCCACCAGGGCCTGA |
|  | CCCTCCAACACCAAAGTGGACAAGA |  | GCAGCCCAGTGACGAAGTCCTTCA |
|  | AGGTCGAACCCAAGTCCTGCGACAA |  | ACCGGGGAGAATGC |
|  | GACTCACACCTGTCCGCCTTGTCCAG |  |  |
|  | CCCCTGAGCTGCTGGGTGGTCCGTCC |  |  |
|  | GTGTTCCTCTTCCCGCCCAAGCCGAA |  |  |
|  | GGACACTCTGATGATTTCACGCACCC |  |  |
|  | CGGAAGTCACTTGCGTGGTCGTGGAC |  |  |
|  | GTGTCGCACGAAGATCCCGAAGTGA |  |  |
|  | AATTCAATTGGTACGTGGATGGGGTC |  |  |
|  | GAAGTGCACAACGCCAAGACCAAGC |  |  |
|  | CTAGGGAAGAACAGTACAACTCTAC |  |  |
|  | GTACCGGGTGGTGTCCGTGCTGACCG |  |  |
|  | TGCTGCACCAGGACTGGCTGAACGG |  |  |
|  | AAAGGAGTACAAGTGCAAAGTGTCA |  |  |
|  | AACAAGGCTCTCCCTGCCCCTATCGA |  |  |
|  | AAAGACCATCAGCAAGGCCAAGGGT |  |  |
|  | CAACCTAGGGAGCCCCAGGTCTATA |  |  |
|  | CTTTGCCGCCTAGCCGGGAAGAAAT |  |  |
|  | GACTAAGAACCAAGTGTCCCTGACTT |  |  |
|  | GCCTTGTCAAGGGCTTTTATCCGTCC |  |  |
|  | GACATCGCCGTGGAGTGGGAGTCCA |  |  |
|  | ACGGACAACCGGAGAACAACTACAA |  |  |
|  | GACCACCCCACCGGTGCTCGATTCCG |  |  |
|  | ATGGCTCCTTCTTCCTGTACTCCAAG |  |  |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CTGACTGTGGACAAGTCAAGATGGC AGCAGGGAAACGTGTTCTCCTGCTCC GTGATGCACGAAGCGCTGCACAACC ATTACACCCAGAAATCACTGTCACTT TCGCCGGGAAAA | | |
| SEQ ID 1785 | CAGCTGCAGCTGCAGGAGTCCGGGG GAGGCTTAGTTCAGCGGGGGGGTC CCTGAGACTCTCCTGCTCAGCCTCTG GAATCAGCTTCAGAGATTACTGGATG CACTGGATCCGCCAAACTCCAGGGA AGGGGCTGGTGTGGGTCTCACGTATT AATCCTGATGGGAGTAGCACAAGCT ACGCGGACTCCGTGAAGGGCCGATT CACCATCTCCAGAGACAATTCCAAG AACACGCTGTATCTGCAAATGAACA GCCTGAGAGCTGAGGACACGGCTGT GTATTACTGTGCGAAAGTTACGGGAC GGAGAGTGGGAGCCCATGACTACTG GGGCCAGGGAACCCTGGTCACCGTC TCCTCAGCATCCACCAAGGGGCCTTC CGTGTTCCCCCTGGCCCCTTCATCCA AGTCGACCTCTGGTGGAACCGCCGC ACTCGGTTGCCTGGTCAAAGACTACT TCCCCGAGCCCGTGACTGTCTCGTGG AACTCGGGCGCCCTCACATCCGGAGT GCATACCTTTCCCGCCGTGTTGCAGT CCAGCGGCCTGTACAGCCTGAGCTCC GTCGTGACAGTGCCGTCCTCCTCCCT TGGAACCCAGACCTATATCTGCAACG TCAATCACAAGCCCTCCAACACCAA AGTGGACAAGAAGGTCGAACCCAAG TCCTGCGACAAGACTCACACCTGTCC GCCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTGC GTGGTCGTGGACGTGTCGCACGAAG ATCCCGAAGTGAAATTCAATTGGTAC GTGGATGGGGTCGAAGTGCACAACG CCAAGACCAAGCCTAGGGAAGAACA GTACAACTCTACGTACCGGGTGGTGT CCGTGCTGACCGTGCTGCACCAGGAC TGGCTGAACGGAAAGGAGTACAAGT GCAAAGTGTCAAACAAGGCTCTCCCT GCCCCTATCGAAAAGACCATCAGCA AGGCCAAGGGTCAACCTAGGGAGCC CCAGGTCTATACTTTGCCGCCTAGCC GGGAAGAAATGACTAAGAACCAAGT GTCCCTGACTTGCCTTGTCAAGGGCT TTTATCCGTCCGACATCGCCGTGGAG TGGGAGTCCAACGGACAACCGGAGA ACAACTACAAGACCACCCCACCGGT GCTCGATTCCGATGGCTCCTTCTTCC TGTACTCCAAGCTGACTGTGGACAAG TCAAGATGGCAGCAGGGAAACGTGT TCTCCTGCTCCGTGATGCACGAAGCG CTGCACAACCATTACACCCAGAAATC ACTGTCACTTTCGCCGGGAAAA | SEQ ID 1893 | GAAACGACACTCACGCAGTCTCCA GGCACCCTGTCTTTGTCTCCAGGGG AAAGAGCCACCCTCTCCTGCAGGG CCAGTCAGAGTGTTAGCAGCAGCT CCTTAGCCTGGTACCAGCAGAAAC CTGGCCAGGCTCCCAGGCTCCTCAT CTATGGTGCATCCAGCAGGGCCAC TGGCATCCCAGACAGGTTCAGTGG CAGTGGGTCTGGGACAGACTTCAC TCTCACCATCAGCAGACTGGAGCC TGAAGATTTTGCAGTGTATTACTGT CAGCAGTATGGTAGCTCACAGACC TTCGGCCAAGGGACACGACTGGAG ATTAAACGTACTGTGGCTGCTCCCT CCGTGTTCATTTTTCCTCCGTCGGA CGAACAGCTGAAGTCCGGAACCGC GTCCGTGGTCTGTCTCCTGAACAAC TTCTATCCGCGCGAGGCGAAAGTG CAGTGGAAGGTCGACAACGCACTG CAGTCGGGAAACTCCCAGGAATCG GTGACCGAGCAGGACTCGAAGGAC TCAACCTACTCATTGTCCTCCACCC TCACCCTGAGCAAGGCCGATTACG AGAAGCATAAGGTCTACGCCTGCG AAGTGACCCACCAGGGCCTGAGCA GCCCAGTGACGAAGTCCTTCAACC GGGGAGAATGC |
| SEQ ID 1786 | CAGGTGCAGCTGGTGCAGTCTGGGG CTGAGGTGAAGAAGCCTGGGGCCTC AGTGAAGGTCTCCTGCAAGGCTTCTG GATACACCTTCACCGGCTACTATATG CACTGGGTGCGACAGGCCCCTGGAC AAGGGCTTGAGTGGATGGGATGGAT CAACCCTAACAGTGGTGGCACAAAC TATGCACAGAAGTTTCAGGGCAGGG TCACCATGACCAGGGACACGTCCATC AGCACAGCCTACATGGAGCTGAGCA GGCTGAGATCTGACGACACGGCCGT GTATTACTGTGCCTTTGCCCAGCCGG GCGCTGAGACGTTGAACTTCGATCTC TGGGGCCGTGGCACCCTGGTCACCGT CTCCTCAGCATCCACCAAGGGGCCTT | SEQ ID 1894 | GATGTTGTGATGACTCAGTCTCCAC TCTCCCTGCCCGTCTCCCTTGGACA GCCGGCCTCCATCTCCTGCAGGTCT AATCAAAGCCTCGTATACAGTGAT GGAGGCACCTACTTGAATTGGTTTC AGCAGAGGGCAGGCCAGTCTCCAA GGCGCCTAGTTTATAAGGTTTCTAA CCGGGACTCTGGGGTCCCAGACAG ATTCAGCGGCAGTGGGTCAGGCAC TGATTTCACACTGAGAATCAGCAG GGTGGAGGCTGAGGATGTTGGGGT TTATTACTGCATGCAAGGGACACA CTGGCCGTACACTTTTGGCCAGGG GACCAAGCTGGAGATCAAACGTAC TGTGGCTGCTCCCTCCGTGTTCATT |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCGTGTTCCCCCTGGCCCCTTCATCC<br>AAGTCGACCTCTGGTGGAACCGCCG<br>CACTCGGTTGCCTGGTCAAAGACTAC<br>TTCCCCGAGCCCGTGACTGTCTCGTG<br>GAACTCGGGCGCCCTCACATCCGGA<br>GTGCATACCTTTCCCGCCGTGTTGCA<br>GTCCAGCGGCCTGTACAGCCTGAGCT<br>CCGTCGTGACAGTGCCGTCCTCCTCC<br>CTTGGAACCCAGACCTATATCTGCAA<br>CGTCAATCACAAGCCCTCCAACACCA<br>AAGTGGACAAGAAGGTCGAACCCAA<br>GTCCTGCGACAAGACTCACACCTGTC<br>CGCCTTGTCCAGCCCCTGAGCTGCTG<br>GGTGGTCCGTCCGTGTTCCTCTTCCC<br>GCCCAAGCCGAAGGACACTCTGATG<br>ATTTCACGCACCCCGGAAGTCACTTG<br>CGTGGTCGTGGACGTGTCGCACGAA<br>GATCCCGAAGTGAAATTCAATTGGTA<br>CGTGGATGGGGTCGAAGTGCACAAC<br>GCCAAGACCAAGCCTAGGGAAGAAC<br>AGTACAACTCTACGTACCGGGTGGTG<br>TCCGTGCTGACCGTGCTGCACCAGGA<br>CTGGCTGAACGGAAAGGAGTACAAG<br>TGCAAAGTGTCAAACAAGGCTCTCCC<br>TGCCCCTATCGAAAAGACCATCAGC<br>AAGGCCAAGGGTCAACCTAGGGAGC<br>CCCAGGTCTATACTTTGCCGCCTAGC<br>CGGGAAGAAATGACTAAGAACCAAG<br>TGTCCCTGACTTGCCTTGTCAAGGGC<br>TTTTATCCGTCCGACATCGCCGTGGA<br>GTGGGAGTCCAACGGACAACCGGAG<br>AACAACTACAAGACCACCCCACCGG<br>TGCTCGATTCCAAGCTGACTGTGGACAA<br>GTCAAGATGGCAGCAGGGAAACGTG<br>TTCTCCTGCTCCGTGATGCACGAAGC<br>GCTGCACAACCATTACACCCAGAAA<br>TCACTGTCACTTTCGCCGGGAAAA | | TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |
| SEQ ID<br>1787 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCAAAAGTGC<br>TGCTTGGAACTGGATCAGGCAGTCCC<br>CATCGAGAGGCCTTGAGTGGCTGGG<br>AAGGACATACTACAGGTCCAAATGG<br>AATAATGATTATGCATTATCTGTGAA<br>AAGTCGAATAACCATCAACCCAGAC<br>ACATCCAAGAACCAGTTCTCCCTGCA<br>GCTGAAGTCTGTGACTCCCGAGGAC<br>ACGGCTCTGTATTACTGTGTAAGACA<br>AGTCGCGGCGGTATGGACGTCTGG<br>GGCCAAGGGACCACGGTCACCGTCT<br>CCTCAGCATCCACCAAGGGGCCTTCC<br>GTGTTCCCCCTGGCCCCTTCATCCAA<br>GTCGACCTCTGGTGGAACCGCCGCAC<br>TCGGTTGCCTGGTCAAAGACTACTTC<br>CCCGAGCCCGTGACTGTCTCGTGGAA<br>CTCGGGCGCCCTCACATCCGGAGTGC<br>ATACCTTTCCCGCCGTGTTGCAGTCC<br>AGCGGCCTGTACAGCCTGAGCTCCGT<br>CGTGACAGTGCCGTCCTCCTCCCTTG<br>GAACCCAGACCTATATCTGCAACGTC<br>AATCACAAGCCCTCCAACACCAAAG<br>TGGACAAGAAGGTCGAACCCAAGTC<br>CTGCGACAAGACTCACACCTGTCCGC<br>CTTGTCCAGCCCCTGAGCTGCTGGGT<br>GGTCCGTCCGTGTTCCTCTTCCCGCC<br>CAAGCCGAAGGACACTCTGATGATTT<br>CACGCACCCCGGAAGTCACTTGCGTG<br>GTCGTGGACGTGTCGCACGAAGATC<br>CCGAAGTGAAATTCAATTGGTACGTG<br>GATGGGGTCGAAGTGCACAACGCCA<br>AGACCAAGCCTAGGGAAGAACAGTA<br>CAACTCTACGTACCGGGTGGTGTCCG | SEQ ID<br>1895 | GACATCCAGTTGACCCAGTCTCCAT<br>CCTCCCTGTCTGCATCTGTAGGAGA<br>CAGAGTCACCGTCACTTGCCGGGC<br>AAGTCAGAGCATTAGCAGCTATTT<br>AAATTGGTATCAGCAGAAACCAGG<br>GAAAGCCCCTCAACTCCTGATCTA<br>CGATGCATCCAATTTGGAAACAGG<br>GGTCCCCTCAAGGTTCAGTGGAAG<br>TGGATCTGGGACAGATTTTACTTTC<br>ACCATCAGCAGCCTGCAGCCTGAA<br>GATTTTGCAACATATTACTGTCAGC<br>AGTTTGATAATGTCCCAGTCACTTT<br>CGGCGGAGGGACCAAGGTGGAAAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAA<br>AAGCATAAGGTCTACGCCTGCGAA<br>GTGACCCACCAGGGCCTGAGCAGC<br>CCAGTGACGAAGTCCTTCAACCGG<br>GGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TGCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | |
| SEQ ID 1788 | CAGGTGCAGCTGGTGCAATCTGGGG<br>GAGGCTTGGTACAGCCAGGGCGGTC<br>CCTGAGACTCTCCTGTACAGCTTCTG<br>GATTCACCTTTGGTGATTATGCTATG<br>AGCTGGTTCCGCCAGGCTCCAGGGA<br>AGGGGCTGGAGTGGGTCTCAGCTATT<br>AGTGGTAGTGGTGGTAGCACATACT<br>ATGCAGACTCCGTGAAGGGCCGATT<br>CACCATCTCCAGAGACAATTCCAAG<br>AACACGCTGTATCTGCAAATGAACA<br>GCCTGAGAGCTGAGGACACGGCTGT<br>GTATTACTGTGCGAAAGGATCGGTAT<br>ATAGTGGGAGCTACTATATGCTCATT<br>GACTACTGGGGCCAGGGCACCCTGG<br>TCACCGTCTCCTCAGCATCCACCAAG<br>GGGCCTTCCGTGTTCCCCCTGGCCCC<br>TTCATCCAAGTCGACCTCTGGTGGAA<br>CCGCCGCACTCGGTTGCCTGGTCAAA<br>GACTACTTCCCCGAGCCCGTGACTGT<br>CTCGTGGAACTCGGGCGCCCTCACAT<br>CCGGAGTGCATACCTTTCCCGCCGTG<br>TTGCAGTCCAGCGGCCTGTACAGCCT<br>GAGCTCCGTCGTGACAGTGCCGTCCT<br>CCTCCCTTGGAACCCAGACCTATATC<br>TGCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | SEQ ID 1896 | GAAATTGTGCTGACTCAGTCTCCAC<br>TCTCCCTGCCCGTCACCCTTGGACA<br>GCCGGCCTCCATCTCCTGCAGGTCT<br>AGTCAAAGCCTCGTATACAGTGAT<br>GGAAACACCTACTTGAATTGGTTTC<br>AGCAGAGGCCAGGCCAATCTCCAA<br>GGCGCCTAATTTATAAGGTTTCTAA<br>CCGGGACTCTGGGGTCCCAGACAG<br>ATTCAGCGGCAGTGGGTCAGGCAC<br>TGATTTCACACTGAAAATCAGCAG<br>GGTGGAGGCTGAGGATGTTGGGGT<br>TTATTACTGCATGCAAGGTACACA<br>CTGGCCTCGAACGTTCGGCCAAGG<br>GACCAAGCTGGAGATCAAACGTAC<br>TGTGGCTGCTCCCTCCGTGTTCATT<br>TTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |
| SEQ ID 1789 | CAGGTACAGCTGCAGCAGTCAGGTC<br>CAGGACTGGTGAGGCCCTCGCAGAC | SEQ ID 1897 | GATGTTGTGATGACTCAGTCTCCAG<br>CCACCCTGTCTGTGTCTCCAGGGGA |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | CCTCTCACTCACCTGTGTCATCTCCG GGGACAGTGTCTCTAGCGGCAGTGCT GCTTGGAACTGGATCAGGCAGTCCCC ATCGAGAGGCCTTGAGTGGCTGGGA AGGACATATTATAGGGCCAAGTGGT ATAATGAATATGCAGGGTCTGTGAA AAGCCGAATAACCATCAGTCCGGAC ACATCCAAGAACCAGTTCTCCCTGCA ACTGAACTCTGTGACTCCCGAGGACA CGGCTGTGTATTTCTGTACAAGACAA GACAAAGCAACACGAGATATTCCG GTTTGGGCGTCTGGGGCCAAGGGAC CACGGTGACCGTCTCCTCAGCATCCA CCAAGGGGCCTTCCGTGTTCCCCCTG GCCCCTTCATCCAAGTCGACCTCTGG TGGAACCGCCGCACTCGGTTGCCTGG TCAAAGACTACTTCCCCGAGCCCGTG ACTGTCTCGTGGAACTCGGGCGCCCT CACATCCGGAGTGCATACCTTTCCCG CCGTGTTGCAGTCCAGCGGCCTGTAC AGCCTGAGCTCCGTCGTGACAGTGCC GTCCTCCTCCCTTGGAACCCAGACCT ATATCTGCAACGTCAATCACAAGCCC TCCAACACCAAAGTGGACAAGAAGG TCGAACCCAAGTCCTGCGACAAGAC TCACACCTGTCCGCCTTGTCCAGCCC CTGAGCTGCTGGGTGGTCCGTCCGTG TTCCTCTTCCCGCCCAAGCCGAAGGA CACTCTGATGATTTCACGCACCCCGG AAGTCACTTGCGTGGTCGTGGACGTG TCGCACGAAGATCCCGAAGTGAAAT TCAATTGGTACGTGGATGGGGTCGA AGTGCACAACGCCAAGACCAAGCCT AGGGAAGAACAGTACAACTCTACGT ACCGGGTGGTGTCCGTGCTGACCGTG CTGCACCAGGACTGGCTGAACGGAA AGGAGTACAAGTGCAAAGTGTCAAA CAAGGCTCTCCCTGCCCCTATCGAAA AGACCATCAGCAAGGCCAAGGGTCA ACCTAGGGAGCCCCAGGTCTATACTT TGCCGCCTAGCCGGGAAGAAATGAC TAAGAACCAAGTGTCCCTGACTTGCC TTGTCAAGGGCTTTTATCCGTCCGAC ATCGCCGTGGAGTGGGAGTCCAACG GACAACCGGAGAACAACTACAAGAC CACCCCACCGGTGCTCGATTCCGATG GCTCCTTCTTCCTGTACTCCAAGCTG ACTGTGGACAAGTCAAGATGGCAGC AGGGAAACGTGTTCTCCTGCTCCGTG ATGCACGAAGCGCTGCACAACCATT ACACCCAGAAATCACTGTCACTTTCG CCGGGAAAA | | |
| SEQ ID 1790 | GAGGTGCAGCTGGTGGAGACCGGGG GAGGCTTAGTTCAGCCTGGGGGGTCC CTGAGACTCTCCTGTGCAGCCTCTGA ATTCACCCTTAGGAACTATGGCGTGA GCTGGGTCCGCCAGGCTCCAGGGAA GGGGCTGGAGTGGGTCTCAGGTATG AGTGGTAGTGGTTATAGTACATACTA CGCAGACTCCGTGAAGGGCCGGTTC ACCATCTCCAGAGACAGTTCCAAGA ACACGCTGTTTCTGCAAATGGACAGC CTGAGAGCCGAGGACACGGCCATAT ATTACTGTGCGAGAGGGCCCCGAAT GTGGAGCAGTGGCATTGATGCTTTTG ATATCTGGGGCCACGGGACAATGGT GACCGTCTCTTCAGCATCCACCAAGG GGCCTTCCGTGTTCCCCCTGGCCCCT TCATCCAAGTCGACCTCTGGTGGAAC CGCCGCACTCGGTTGCCTGGTCAAAG ACTACTTCCCCGAGCCCGTGACTGTC TCGTGGAACTCGGGCGCCCTCACATC CGGAGTGCATACCTTTCCCGCCGTGT TGCAGTCCAGCGGCCTGTACAGCCTG | SEQ ID 1898 | GATGTTGTGATGACTCAGTCTCCAT CCTCCCTGTCTGCATCTGTGGGGGA CAGCGTCGCCATACTTGCCGGGC AAGTCAGAGCATTAGCAACTATTT AAATTGGTATCAGCAGAGACCAGG GAAAGCCCCTAAGCTCCTGATCTTT GCTGCATCCAGTTTGCAAAGTGGG GTCCCATCAAGGTTCAGTGGCAGT GGATCTGGGACAGATTTCACTCTC ACCATCAGCAGTCTGCAACCTGAA GATTTTGCAACTTACTCCTGTCAAC AGAGTTACATTACCCCGTGGACGT TCGGCCAAGGGACCAAGCTGGAGA TCAAACGTACTGTGGCTGCTCCCTC CGTGTTCATTTTCCTCCGTCGGAC GAACAGCTGAAGTCCGGAACCGCG TCCGTGGTCTGTCTCCTGAACACT TCTATCCGCGCGAGGCGAAAGTGC AGTGAAGGTCGACAACGCACTGC AGTCGGGAAACTCCCAGGAATCGG TGACCGAGCAGGACTCGAAGGACT CAACCTACTCATTGTCCTCCACCCT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AGCTCCGTCGTGACAGTGCCGTCCTC CTCCCCTTGGAACCCAGACCTATATCT GCAACGTCAATCACAAGCCCTCCAA CACCAAAGTGGACAAGAAGGTCGAA CCCAAGTCCTGCGACAAGACTCACA CCTGTCCGCCTTGTCCAGCCCCTGAG CTGCTGGGTGGTCCGTCCGTGTTCCT CTTCCCGCCCAAGCCGAAGGACACTC TGATGATTTCACGCACCCCGGAAGTC ACTTGCGTGGTCGTGGACGTGTCGCA CGAAGATCCCGAAGTGAAATTCAAT TGGTACGTGGATGGGGTCGAAGTGC ACAACGCCAAGACCAAGCCTAGGGA AGAACAGTACAACTCTACGTACCGG GTGGTGTCCGTGCTGACCGTGCTGCA CCAGGACTGGCTGAACGGAAAGGAG TACAAGTGCAAAGTGTCAAACAAGG CTCTCCCTGCCCCTATCGAAAAGACC ATCAGCAAGGCCAAGGGTCAACCTA GGGAGCCCCAGGTCTATACTTTGCCG CCTAGCCGGGAAGAAATGACTAAGA ACCAAGTGTCCCTGACTTGCCTTGTC AAGGGCTTTTATCCGTCCGACATCGC CGTGGAGTGGGAGTCCAACGGACAA CCGGAGAACAACTACAAGACCACCC CACCGGTGCTCGATTCCGATGGCTCC TTCTTCCTGTACTCCAAGCTGACTGT GGACAAGTCAAGATGGCAGCAGGGA AACGTGTTCTCCTGCTCCGTGATGCA CGAAGCGCTGCACAACCATTACACC CAGAAATCACTGTCACTTTCGCCGGG AAAA | | CACCCTGAGCAAGGCCGATTACGA GAAGCATAAGGTCTACGCCTGCGA AGTGACCCACCAGGGCCTGAGCAG CCCAGTGACGAAGTCCTTCAACCG GGGAGAATGC |
| SEQ ID 1791 | CAGGTGCAGCTACAGCAGTGGGGCG CAGGACTGTTGAAGCCTTCGGAGAC CCTGTCCCTCACCTGCGCTGTCTATG GTGGGTCCGTCAGTGGTTACTACTGG AGCTGGATCCGCCAGCCCCCAGGGA AGGGGCTGGAGTGGATGGGGGAAAT CCATCATAGTGGAAGCACCAACTAC AACCCGTCCCTCAAGAGTCGAGTCAC CATATCACTAGACACGCCCAAGAAC CAGTTCTCCCTGAAGCTAAGCTCTGT GACCGCCGCGGACACGGCTGTATATT ACTGTGCGAGACGGGATTGGGCAGG AAAAAGGGTCTGGGGCCAGGGAACC CTGGTCACCGTCTCCTCAGCATCCAC CAAGGGGCCTTCCGTGTTCCCCCTGG CCCCTTCATCCAAGTCGACCTCTGGT GGAACCGCCGCACTCGGTTGCCTGGT CAAAGACTACTTCCCCGAGCCCGTGA CTGTCTCGTGGAACTCGGGCGCCCTC ACATCCGGAGTGCATACCTTTCCCGC CGTGTTGCAGTCCAGCGGCCTGTACA GCCTGAGCTCCGTCGTGACAGTGCCG TCCTCCTCCCTTGGAACCCAGACCTA TATCTGCAACGTCAATCACAAGCCCT CCAACACCAAAGTGGACAAGAAGGT CGAACCCAAGTCCTGCGACAAGACT CACACCTGTCCGCCTTGTCCAGCCCC TGAGCTGCTGGGTGGTCCGTCCGTGT TCCTCTTCCCGCCCAAGCCGAAGGAC ACTCTGATGATTTCACGCACCCCGGA AGTCACTTGCGTGGTCGTGGACGTGT CGCACGAAGATCCCGAAGTGAAATT CAATTGGTACGTGGATGGGGTCGAA GTGCACAACGCCAAGACCAAGCCTA GGGAAGAACAGTACAACTCTACGTA CCGGGTGGTGTCCGTGCTGACCGTGC TGCACCAGGACTGGCTGAACGGAAA GGAGTACAAGTGCAAAGTGTCAAAC AAGGCTCTCCCTGCCCCTATCGAAAA GACCATCAGCAAGGCCAAGGGTCAA CCTAGGGAGCCCCAGGTCTATACTTT GCCGCCTAGCCGGGAAGAAATGACT | SEQ ID 1899 | GATGTTGTGATGACTCAGTCTCCAG GCACCCTGTCTTTGTCTCCAGGGGA AAGAGCCACCCTCTCCTGCAGGGC CAGTCAGAGTGTTAGCACCCTCTTA GCCTGGTACCAACAGAAACCTGGC CAGGCTCCCAGGCTCCTCATCTATG ATGCATCCAACAGGGCCACTGGCA TCCCAGGCAGGTTCAGTGCCAGTG GGTCTGGGACAGACTTCAGTCTCA CCATCAGCAGCCTAGAGACTGAAG ATTCTGCAGTTTATTACTGTCAGCA CCGTTACGTGTGGCCGTTCACTTTC GGCGGAGGGACCAAGCTGGAGATC AAACGTACTGTGGCTGCTCCCTCCG TGTTCATTTTTCCTCCGTCGGACGA ACAGCTGAAGTCCGGAACCGCGTC CGTGGTCTGTCTCCTGAACAACTTC TATCCGCGCGAGGCGAAAGTGCAG TGGAAGGTCGACAACGCACTGCAG TCGGGAAACTCCCAGGAATCGGTG ACCGAGCAGGACTCGAAGGACTCA ACCTACTCATTGTCCTCCACCCTCA CCCTGAGCAAGGCCGATTACGAGA AGCATAAGGTCTACGCCTGCGAAG TGACCCACCAGGGCCTGAGCAGCC CAGTGACGAAGTCCTTCAACCGGG GAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AAGAACCAAGTGTCCCTGACTTGCCT<br>TGTCAAGGGCTTTTATCCGTCCGACA<br>TCGCCGTGGAGTGGGAGTCCAACGG<br>ACAACCGGAGAACAACTACAAGACC<br>ACCCCACCGGTGCTCGATTCCGATGG<br>CTCCTTCTTCCTGTACTCCAAGCTGA<br>CTGTGGACAAGTCAAGATGGCAGCA<br>GGGAAACGTGTTCTCCTGCTCCGTGA<br>TGCACGAAGCGCTGCACAACCATTA<br>CACCCAGAAATCACTGTCACTTTCGC<br>CGGGAAAA | | |
| SEQ ID 1792 | CAGGTACAGCTGCAGCAGTCAGGTC<br>CAGGACTATTAAAGCCCTCGCAGAC<br>CCTCTCACTCACCTGTGCCATCTCCG<br>GGGACAGTGTCTCTAGCAACACTGCT<br>ACTTGGAACTGGATCAGGCAGTCCCC<br>ATCGAGAGGCCTTGAGTGGCTGGGA<br>AGGACATACTACAGGTCCAAGTGGT<br>ATAAGGATAATGCACTGTCTGTGAA<br>AAGTCGAATAACCATCAACCCAGAC<br>ACATCCAAGAACCAGTTCTCCCTGCA<br>GCTGAACTCTGTGACTCCCGAGGACA<br>CGGCTGTGTATTACTGTGCAGGAGGT<br>CGGGCTGGTATTGCCGCTTTTGATAT<br>CTGGGGCCAAGGGACCACGGTCACC<br>GTCTCCTCAGCATCCACCAAGGGGCC<br>TTCCGTGTTCCCCCTGGCCCCTTCATC<br>CAAGTCGACCTCTGGTGGAACCGCC<br>GCACTCGGTTGCCTGGTCAAAGACTA<br>CTTCCCCGAGCCCGTGACTGTCTCGT<br>GGAACTCGGGCGCCCTCACATCCGG<br>AGTGCATACCTTTCCCGCCGTGTTGC<br>AGTCCAGCGGCCTGTACAGCCTGAG<br>CTCCGTCGTGACAGTGCCGTCCTCCT<br>CCCTTGGAACCCAGACCTATATCTGC<br>AACGTCAATCACAAGCCCTCCAACA<br>CCAAAGTGGACAAGAAGGTCGAACC<br>CAAGTCCTGCGACAAGACTCACACCT<br>GTCCGCCTTGTCCAGCCCCTGAGCTG<br>CTGGGTGGTCCGTCCGTGTTCCTCTT<br>CCCGCCCAAGCCGAAGGACACTCTG<br>ATGATTTCACGCACCCCGGAAGTCAC<br>TTGCGTGGTCGTGGACGTGTCGCACG<br>AAGATCCCGAAGTGAAATTCAATTG<br>GTACGTGGATGGGGTCGAAGTGCAC<br>AACGCCAAGACCAAGCCTAGGGAAG<br>AACAGTACAACTCTACGTACCGGGT<br>GGTGTCCGTGCTGACCGTGCTGCACC<br>AGGACTGGCTGAACGGAAAGGAGTA<br>CAAGTGCAAAGTGTCAAACAAGGCT<br>CTCCCTGCCCCTATCGAAAAGACCAT<br>CAGCAAGGCCAAGGGTCAACCTAGG<br>GAGCCCCAGGTCTATACTTTGCCGCC<br>TAGCCGGGAAGAAATGACTAAGAAC<br>CAAGTGTCCCTGACTTGCCTTGTCAA<br>GGGCTTTTATCCGTCCGACATCGCCG<br>TGGAGTGGGAGTCCAACGGACAACC<br>GGAGAACAACTACAAGACCACCCCA<br>CCGGTGCTCGATTCCGATGCTCCTT<br>CTTCCTGTACTCCAAGCTGACTGTGG<br>ACAAGTCAAGATGGCAGCAGGGAAA<br>CGTGTTCTCCTGCTCCGTGATGCACG<br>AAGCGCTGCACAACCATTACACCCA<br>GAAATCACTGTCACTTTCGCCGGGAA<br>AA | SEQ ID 1900 | GACATCCAGATGACCCAGTCTCCA<br>TCCTCCCTGTCTGCATCTGTAGGAG<br>ACAGAGTCACCATCACTTGCCGGG<br>CAAGTCAGGGCATTAGAAATGATT<br>TAGGCTGGTATCAGCAGAAACCAG<br>GGAAAGCCCCTAAGCGTCTGATCT<br>ATGGTGCATCCAGTTTGCAAAGTG<br>GAGTCCCATCAAGGTTCAGCGGCA<br>GTGGATCTGGGACAGAATTCACTC<br>TCACAATCAGGAGCCTGCAGCCTG<br>AAGATTTTGCAACTTATTATTGTCT<br>ACAGCATAATTCCTACCCTCGAAC<br>ATTCGGCCAAGGGACCAAGGTGGA<br>AATCAAACGTACTGTGGCTGCTCC<br>CTCCGTGTTCATTTTTCCTCCGTCG<br>GACGAACAGCTGAAGTCCGGAACC<br>GCGTCCGTGGTCTGTCTCCTGAACA<br>ACTTCTATCCGCGCGAGGCGAAAG<br>TGCAGTGGAAGGTCGACAACGCAC<br>TGCAGTCGGGAAACTCCCAGGAAT<br>CGGTGACCGAGCAGGACTCGAAGG<br>ACTCAACCTACTCATTGTCCTCCAC<br>CCTCACCCTGAGCAAGGCCGATTA<br>CGAGAAGCATAAGGTCTACGCCTG<br>CGAAGTGACCCACCAGGGCCTGAG<br>CAGCCCAGTGACGAAGTCCTTCAA<br>CCGGGGAGAATGC |
| SEQ ID 1793 | CAGGTGCAGCTGGTGCAATCTGGAG<br>GAGGCTTGATCCAGCCTGGGGGGTC<br>CCTGAGACTCTCCTGTGCAGCCTCTG<br>GGTTCACCGTCAGTAGCAACTACATG<br>AGCTGGGTCCGCCAGGCTCCAGGGA<br>AGGGGCTGGAATGGGTCTCACTTATT<br>TATAGTGATGGTCGCACAAACTATGC<br>AGACTCCGTGAAGGGCCGATTCACC | SEQ ID 1901 | GATGTTGTGATGACTCAGTCTCCAG<br>CCACCCTGTCTTTGTCTCCAGGGGA<br>AAGAGCCACCCTCTCCTGCAGGGC<br>CAGTCAGAGTGTTAGCAGCTACTT<br>AGCCTGGTACCAACAGAAACCTGG<br>CCAGGCTCCCAGGCTCCTCATCTAT<br>GATGCATCCAACAGGGCCACTGGC<br>ATCCCAGCCAGGTTCAGTGGCAGT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ATCTCCAGAGACAATTCCAAGAACA CGCTGTATCTGCAAATGAACAGCCTG AGAGCCGAGGACACGGCCGTATATT ACTGTGCGAAGGGGGCCCTACAGGG CGAATGGCGGAGATTTGACTACTGG GGCCAGGGCACCCTGGTCACCGTCTC CTCAGCATCCACCAAGGGGCCTTCCG TGTTCCCCCTGGCCCCTTCATCCAAG TCGACCTCTGGTGGAACCGCCGCACT CGGTTGCCTGGTCAAAGACTACTTCC CCGAGCCCGTGACTGTCTCGTGGAAC TCGGGCGCCCTCACATCCGGAGTGCA TACCTTTCCCGCCGTGTTGCAGTCCA GCGGCCTGTACAGCCTGAGCTCCGTC GTGACAGTGCCGTCCTCCTCCCTTGG AACCCAGACCTATATCTGCAACGTCA ATCACAAGCCCTCCAACACCAAAGT GGACAAGAAGGTCGAACCCAAGTCC TGCGACAAGACTCACACCTGTCCGCC TTGTCCAGCCCCTGAGCTGCTGGGTG GTCCGTCCGTGTTCCTCTTCCCGCCC AAGCCGAAGGACACTCTGATGATTTC ACGCACCCCGGAAGTCACTTGCGTG GTCGTGGACGTGTCGCACGAAGATC CCGAAGTGAAATTCAATTGGTACGTG GATGGGGTCGAAGTGCACAACGCCA AGACCAAGCCTAGGGAAGAACAGTA CAACTCTACGTACCGGGTGGTGTCCG TGCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG CCAAGGGTCAACCTAGGGAGCCCCA GGTCTATACTTTGCCGCCTAGCCGGG AAGAAATGACTAAGAACCAAGTGTC CCTGACTTGCCTTGTCAAGGGCTTTT ATCCGTCCGACATCGCCGTGGAGTGG GAGTCCAACGGACAACCGGAGAACA ACTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCTG CACAACCATTACACCCAGAAATCACT GTCACTTTCGCCGGGAAAA | | GGGTCTGGGACAGACTTCACTCTC ACCATCAGCAGCCTAGAGCCTGAA GATTTTGCAGTTTATTACTGTCAGC AGCGTAGCAACTGGCCGTGGACGT TCGGCCAAGGGACCAAGCTGGAGA TCAAACGTACTGTGGCTGCTCCCTC CGTGTTCATTTTTCCTCCGTCGGAC GAACAGCTGAAGTCCGGAACCGCG TCCGTGGTCTGTCTCCTGAACAACT TCTATCCGCGCGAGGCGAAAGTGC AGTGGAAGGTCGACAACGCACTGC AGTCGGGAAACTCCCAGGAATCGG TGACCGAGCAGGACTCGAAGGACT CAACCTACTCATTGTCCTCCACCCT CACCCTGAGCAAGGCCGATTACGA GAAGCATAAGGTCTACGCCTGCGA AGTGACCCACCAGGGCCTGAGCAG CCCAGTGACGAAGTCCTTCAACCG GGGAGAATGC |
| SEQ ID 1794 | CAGGTGCAGCTACAGCAGTCAGGTC CAGGACTGGTGAAGCCCTCGCAGAC CCTCTCACTCACCTGTGCCATCTCCG GGGACAGTGTCTCTAGCAACAGTGCT GCTTGGAACTGGATCAGGCAGTCCCC ATCGAGAGGCCTTGAGTGGCTGGGA AGGACATATTACAGGTCCAAGTGGT ATAATGATTATGCAGTATCTGTGAAA AGTCGAATAACCATCAACCCAGACA CATCCAAGAACCAGTTCTCCCTGCAG CTGAACTCTGTGACTCCCGAGGACAC GGCTGTGTATTACTGTACAAGAACCA ACCAGGGATACGGTGGTAACTCCGG GGTATTTGACTACTGGGGCCAGGGA ACCCTGGTCACCGTCTCCTCAGCATC CACCAAGGGGCCTTCCGTGTTCCCCC TGGCCCCTTCATCCAAGTCGACCTCT GGTGGAACCGCCGCACTCGGTTGCCT GGTCAAAGACTACTTCCCCGAGCCCG TGACTGTCTCGTGGAACTCGGGCGCC CTCACATCCGGAGTGCATACCTTTCC CGCCGTGTTGCAGTCCAGCGGCCTGT ACAGCCTGAGCTCCGTCGTGACAGTG CCGTCCTCCTCCCTTGGAACCCAGAC CTATATCTGCAACGTCAATCACAAGC CCTCCAACACCAAAGTGGACAAGAA GGTCGAACCCAAGTCCTGCGACAAG ACTCACACCTGTCCGCCTTGTCCAGC CCCTGAGCTGCTGGGTGGTCCGTCCG | SEQ ID 1902 | GATGTTGTGATGACTCAGTCTCCGC TCTCCCTGCCCGTCACCCTTGGACA GGCGGCCTCCATCTCCTGCAGGTCT AGTCATAGCCTCACAACTACTGAT GGACGTACTTACGTGGCTTGGTTTC AGCAGAGGCCAGGCCAATCTCCAA GGCGCCTTCTTTATGAGGTTTCTAA GCGGGACTCTGGGGCCCCAGACAG ATTCAGCGGCAGTGGGTCAGGCAC TGATTTCACTCTGAAAATCAGCAG GGTGGAGGCTGACGATGTTGGAAT TTATCATTGCATGCAAGGAACACA TGGGCCTCACACGTTCGGCCAAGG GACCAAGCTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | TGTTCCTCTTCCCGCCCAAGCCGAAG<br>GACACTCTGATGATTTCACGCACCCC<br>GGAAGTCACTTGCGTGGTCGTGGAC<br>GTGTCGCACGAAGATCCCGAAGTGA<br>AATTCAATTGGTACGTGGATGGGGTC<br>GAAGTGCACAACGCCAAGACCAAGC<br>CTAGGGAAGAACAGTACAACTCTAC<br>GTACCGGGTGGTGTCCGTGCTGACCG<br>TGCTGCACCAGGACTGGCTGAACGG<br>AAAGGAGTACAAGTGCAAAGTGTCA<br>AACAAGGCTCTCCCTGCCCCTATCGA<br>AAAGACCATCAGCAAGGCCAAGGGT<br>CAACCTAGGGAGCCCCAGGTCTATA<br>CTTTGCCGCCTAGCCGGGAAGAAAT<br>GACTAAGAACCAAGTGTCCCTGACTT<br>GCCTTGTCAAGGGCTTTTATCCGTCC<br>GACATCGCCGTGGAGTGGGAGTCCA<br>ACGGACAACCGGAGAACAACTACAA<br>GACCACCCCACCGGTGCTCGATTCCG<br>ATGGCTCCTTCTTCCTGTACTCCAAG<br>CTGACTGTGGACAAGTCAAGATGGC<br>AGCAGGGAAACGTGTTCTCCTGCTCC<br>GTGATGCACGAAGCGCTGCACAACC<br>ATTACACCCAGAAATCACTGTCACTT<br>TCGCCGGGAAAA | | |
| SEQ ID<br>1795 | CAGGTGCAGCTACAGCAGTCAGGTC<br>CAGGACTGGTGAAGCCCTCGCAGAC<br>CCTCTCACTCACCTGTGCCATCTCCG<br>GGGACAGTGTCTCTGGCAACAGTGCT<br>GCTTGGAACTGGATCAGGCAGTCCCC<br>ATCGAGAGGCCTTGAGTGGCTGGGA<br>AGGACATACTACAGGTCCAAGTGGT<br>ATAATGATTATGCAGTATCTGTGAAA<br>AGTCGAATAACCATCAACCCAGACA<br>CATCCAAGAACCAGTTCTCCCTGCAG<br>TTGAATTCTGTGACTCCCGAGGACAC<br>GGCTGTGTATTACTGTGCGAGGATAG<br>TGGGAGGTGCCGTTGACTGCTGGGG<br>CCAGGGAACCCTGGTGACCGTCTCCT<br>CAGCATCCACCAAGGGGCCTTCCGTG<br>TTCCCCCTGGCCCCTTCATCCAAGTC<br>GACCTCTGGTGGAACCGCCGCACTCG<br>GTTGCCTGGTCAAAGACTACTTCCCC<br>GAGCCCGTGACTGTCTCGTGGAACTC<br>GGGCGCCCTCACATCGGAGTGCAT<br>ACCTTTCCCGCCGTGTTGCAGTCCAG<br>CGGCCTGTACAGCCTGAGCTCCGTCG<br>TGACAGTGCCGTCCTCCTCCCTTGGA<br>ACCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCCT<br>TGTCCAGCCCCTGAGCTGCTGGGTGG<br>TCCGTCCGTGTTCCTCTTCCCGCCCA<br>AGCCGAAGGACACTCTGATGATTTCA<br>CGCACCCCGGAAGTCACTTGCGTGGT<br>CGTGGACGTGTCGCACGAAGATCCC<br>GAAGTGAAATTCAATTGGTACGTGG<br>ATGGGTCGAAGTGCACAACGCCAA<br>GACCAAGCCTAGGGAAGAACAGTAC<br>AACTCTACGTACCGGGTGGTGTCCGT<br>GCTGACCGTGCTGCACCAGGACTGG<br>CTGAACGGAAAGGAGTACAAGTGCA<br>AAGTGTCAAACAAGGCTCTCCCTGCC<br>CCTATCGAAAAGACCATCAGCAAGG<br>CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA | SEQ ID<br>1903 | GAAACGACACTCACGCAGTCTCCA<br>GCCACCCTGTCTGTGTCTCCAGGGG<br>AAAGAGCCACCCTCTCCTGCAGGG<br>CCAGTCAAAGTGTTACCAGCAACT<br>TAGCCTGGTACCAGCAGAAACCTG<br>GCCAGGCTCCCAGGCTCCTCATCTA<br>TGGTGCATCCAACAGGGCCACTGG<br>TATCCCAGCCAGGTTCAGTGTCAGT<br>GGGTCTGGGACAGACTTCACTCTC<br>ACCATCAGCAGACTGGAGCCTGAA<br>GATTTTGCAGTGTATTACTGTCAGC<br>AGTATGGTAGTCCACCTCCGACCA<br>CCTTCGGCCAAGGGACACGACTGG<br>AGATTAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | AGATGGCAGCAGGGAAACGTGTTCT CCTGCTCCGTGATGCACGAAGCGCTG CACAACCATTACACCCAGAAATCACT GTCACTTTCGCCGGGAAAA | | |
| SEQ ID 1796 | GAGGTGCAGCTGGTGCAGTCTGGGG CTGAGGTGAAGAAGCCTGGGGCCTC AGTGAAGGTTTCCTGCAAGGCTTCTG GATACACCTTCACTAGCTATGCTATG CATTGGGTGCGCCAGGCCCCCGGAC AAAAGGCTTGAGTGGATGGGATGGAT CAACGCTGGCAATGGTAACACAAAA TATTCACAGAAGTTCCAGGGCAGAG TCACCATTACCAGGGACACATCCGCG AGCACAGCCTACATGGAGCTGAGCA GCCTGAGATCTGAAGACACGGCTGT GTATTACTGTGCGAGAGTTAGAGTGG GAGCTACTACTGTTTACGACAGCTGG TTCGACCCCTGGGGCCAGGGAACCCT GGTGACCGTCTCCTCAGCATCCACCA AGGGGCCTTCCGTGTTCCCCCTGGCC CCTTCATCCAAGTCGACCTCTGGTGG AACCGCCGCACTCGGTTGCCTGGTCA AAGACTACTTCCCCGAGCCCGTGACT GTCTCGTGGAACTCGGGCGCCCTCAC ATCCGGAGTGCATACCTTTCCCGCCG TGTTGCAGTCCAGCGGCCTGTACAGC CTGAGCTCCGTCGTGACAGTGCCGTC CTCCTCCCTTGGAACCCAGACCTATA TCTGCAACGTCAATCACAAGCCCTCC AACACCAAAGTGGACAAGAAGGTCG AACCCAAGTCCTGCGACAAGACTCA CACCTGTCCGCCTTGTCCAGCCCCTG AGCTGCTGGGTGGTCCGTCCGTGTTC CTCTTCCCGCCCAAGCCGAAGGACAC TCTGATGATTTCACGCACCCCGGAAG TCACTTGCGTGGTCGTGGACGTGTCG CACGAAGATCCCGAAGTGAAATTCA ATTGGTACGTGGATGGGGTCGAAGT GCACAACGCCAAGACCAAGCCTAGG GAAGAACAGTACAACTCTACGTACC GGGTGGTGTCCGTGCTGACCGTGCTG CACCAGGACTGGCTGAACGGAAAGG AGTACAAGTGCAAAGTGTCAAACAA GGCTCTCCCTGCCCCTATCGAAAAGA CCATCAGCAAGGCCAAGGGTCAACC TAGGGAGCCCCAGGTCTATACTTTGC CGCCTAGCCGGGAAGAAATGACTAA GAACCAAGTGTCCCTGACTTGCCTTG TCAAGGGCTTTTATCCGTCCGACATC GCCGTGGAGTGGGAGTCCAACGGAC AACCGGAGAACAACTACAAGACCAC CCCACCGGTGCTCGATTCCGATGGCT CCTTCTTCCTGTACTCCAAGCTGACT GTGGACAAGTCAAGATGGCAGCAGG GAAACGTGTTCTCCTGCTCCGTGATG CACGAAGCGCTGCACAACCATTACA CCCAGAAATCACTGTCACTTTCGCCG GGAAAA | SEQ ID 1904 | GATGTTGTGATGACTCAGTCTCCAG GCACCCTGTCTTTGTCTCCAGGGGA AAGAGCCACCCTCTCCTGCAGGGC CAGTCAGAGTGTTAGCAGCAGCTA CTTAGCCTGGTACCAGCAGAAACC TGGCCAGGCTCCCAGGCTCCTCATC TATGGTGCATCCAGCAGGGCCACT GGCATCCCAGACAGGTTCAGTGGC AGTGGGTCTGGGACAGACTTCACT CTCACCATCAGCAGACTGGAGCCT GAAGATTTTGCAGTGTATTACTGTC AGCAGTATGGTAGCTCACGTCGGA CGTTCGGCCAAGGGACCAAGCTGG AGATCAAACGTACTGTGGCTGCTC CCTCCGTGTTCATTTTTCCTCCGTC GGACGAACAGCTGAAGTCCGGAAC CGCGTCCGTGGTCTGTCTCCTGAAC AACTTCTATCCGCGCGAGGCGAAA GTGCAGTGGAAGGTCGACAACGCA CTGCAGTCGGGAAACTCCCAGGAA TCGGTGACCGAGCAGGACTCGAAG GACTCAACCTACTCATTGTCCTCCA CCCTCACCCTGAGCAAGGCCGATT ACGAGAAGCATAAGGTCTACGCCT GCGAAGTGACCCACCAGGGCCTGA GCAGCCCAGTGACGAAGTCCTTCA ACCGGGGAGAATGC |
| SEQ ID 1797 | CAGGTGCAGCTGGTGCAGTCTGGGG GAGGCTTGGTACAGCCTGGGGGGTC CCTGAGACTCTCCTGTGCAGCCTCTG GATTCACCTTTAGCAGCTATGCCATG AGCTGGGTCCGCCAGGCTCCAGGGA AGGGGCTGGAGTGGGTCTCAGCTATT AGTGGTAGTGGTGGTAGCACATACT ACGCAGACTCCGTGAAGGGCCGGTT CACCATCTCCAGAGACAATTCCAAG AACACGCTGTATCTGCAAATGAACA GCCTGAGAGCCGAGGACACGGCCGT ATATTACTGTGCGAAAGATGGGGGG TCCAGCCCATACTATGATAGTAGTGG TTTACTACCCTGGTACTTCGATCTCT GGGGCCGTGGCACCCTGGTCACCGTC | SEQ ID 1905 | GAAACGACACTCACGCAGTCTCCA GGCACCCTGTCTTGTCTCCAGGGG AAAGAGCCACCCTCTCCTGCAGGG CCAGTCAGAGTGTTTTCAACAACT ACTTAGCCTGGTACCAACAGAGAC CTGGCCAGGCTCCCAGGCTCCTCAT CTATGGTGCATCCAGCAGGGCCAC TGGCATCCCAGACAGGTTCAGTGG CGGTGGGTCTGGGACAGACTTCAC TCTCACCATCAGCAGACTGGAGCC TGAAGATTTCGCAGTGTATTGCTGT CAGCAGTATGGTAGTTCACCGATC ACCTTCGGCCAAGGGACACGACTG GAGATTAAACGTACTGTGGCTGCT CCCTCCGTGTTCATTTTTCCTCCGT |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | TCCTCAGCATCCACCAAGGGGCCTTC<br>CGTGTTCCCCCTGGCCCCTTCATCCA<br>AGTCGACCTCTGGTGGAACCGCCGC<br>ACTCGGTTGCCTGGTCAAAGACTACT<br>TCCCCGAGCCCGTGACTGTCTCGTGG<br>AACTCGGGCGCCCTCACATCCGGAGT<br>GCATACCTTTCCCGCCGTGTTGCAGT<br>CCAGCGGCCTGTACAGCCTGAGCTCC<br>GTCGTGACAGTGCCGTCCTCCTCCCT<br>TGGAACCCAGACCTATATCTGCAACG<br>TCAATCACAAGCCCTCCAACACCAA<br>AGTGGACAAGAAGGTCGAACCCAAG<br>TCCTGCGACAAGACTCACACCTGTCC<br>GCCTTGTCCAGCCCCTGAGCTGCTGG<br>GTGGTCCGTCCGTGTTCCTCTTCCCG<br>CCCAAGCCGAAGGACACTCTGATGA<br>TTTCACGCACCCCGGAAGTCACTTGC<br>GTGGTCGTGGACGTGTCGCACGAAG<br>ATCCCGAAGTGAAATTCAATTGGTAC<br>GTGGATGGGGTCGAAGTGCACAACG<br>CCAAGACCAAGCCTAGGGAAGAACA<br>GTACAACTCTACGTACCGGGTGGTGT<br>CCGTGCTGACCGTGCTGCACCAGGAC<br>TGGCTGAACGGAAAGGAGTACAAGT<br>GCAAAGTGTCAAACAAGGCTCTCCCT<br>GCCCCTATCGAAAAGACCATCAGCA<br>AGGCCAAGGGTCAACCTAGGGAGCC<br>CCAGGTCTATACTTTGCCGCCTAGCC<br>GGGAAGAAATGACTAAGAACCAAGT<br>GTCCCTGACTTGCCTTGTCAAGGGCT<br>TTTATCCGTCCGACATCGCCGTGGAG<br>TGGGAGTCCAACGGACAACCGGAGA<br>ACAACTACAAGACCACCCCACCGGT<br>GCTCGATTCCGATGGCTCCTTCTTCC<br>TGTACTCCAAGCTGACTGTGGACAAG<br>TCAAGATGGCAGCAGGGAAACGTGT<br>TCTCCTGCTCCGTGATGCACGAAGCG<br>CTGCACAACCATTACACCCAGAAATC<br>ACTGTCACTTTCGCCGGGAAAA | | CGGACGAACAGCTGAAGTCCGGAA<br>CCGCGTCCGTGGTCTGTCTCCTGAA<br>CAACTTCTATCCGCGCGAGGCGAA<br>AGTGCAGTGGAAGGTCGACAACGC<br>ACTGCAGTCGGGAAACTCCCAGGA<br>ATCGGTGACCGAGCAGGACTCGAA<br>GGACTCAACCTACTCATTGTCCTCC<br>ACCCTCACCCTGAGCAAGGCCGAT<br>TACGAGAAGCATAAGGTCTACGCC<br>TGCGAAGTGACCCACCAGGGCCTG<br>AGCAGCCCAGTGACGAAGTCCTTC<br>AACCGGGGAGAATGC |
| SEQ ID 1798 | CAGGTGCAGCTGCAGGAGTCGGGGG<br>GAGGCTTGGTCCAGCCTGGGGGGTC<br>CCTGAGACTCTCCTGTGCAGCCTCTG<br>GATTCACCTTCAGTAGCTATGCTATG<br>CACTGGGTCCGCCAGGCTCCAGGGA<br>AGGGACTGGAATATGTTTCAGCTATT<br>AGTAGTAATGGGGGTAGCACATATT<br>ATGCAAACTCTGTGAAGGGCAGATT<br>CACCATCTCCAGAGACAATTCCAAG<br>AACACGCTGTATCTTCAAATGGGCAG<br>CCTGAGAGCTGAGGACATGGCTGTG<br>TATTACTGTGCGAGAGCTAAGTTTTG<br>GACATACTACTTTGACTACTGGGGCC<br>AGGGAACCCTGGTGACCGTCTCCTCA<br>GCATCCACCAAGGGGCCTTCCGTGTT<br>CCCCCTGGCCCCTTCATCCAAGTCGA<br>CCTCTGGTGGAACCGCCGCACTCGGT<br>TGCCTGGTCAAAGACTACTTCCCCGA<br>GCCCGTGACTGTCTCGTGGAACTCGG<br>GCGCCCTCACATCCGGAGTGCATACC<br>TTTCCCGCCGTGTTGCAGTCCAGCGG<br>CCTGTACAGCCTGAGCTCCGTCGTGA<br>CAGTGCCGTCCTCCTCCCTTGGAACC<br>CAGACCTATATCTGCAACGTCAATCA<br>CAAGCCCTCCAACACCAAAGTGGAC<br>AAGAAGGTCGAACCCAAGTCCTGCG<br>ACAAGACTCACACCTGTCCGCCTTGT<br>CCAGCCCCTGAGCTGCTGGGTGGTCC<br>GTCCGTGTTCCTCTTCCCGCCCAAGC<br>CGAAGGACACTCTGATGATTTCACGC<br>ACCCCGGAAGTCACTTGCGTGGTCGT<br>GGACGTGTCGCACGAAGATCCCGAA<br>GTGAAATTCAATTGGTACGTGGATGG<br>GGTCGAAGTGCACAACGCCAAGACC<br>AAGCCTAGGGAAGAACAGTACAACT | SEQ ID 1906 | GAAATTGTGCTGACTCAGTCTCCA<br>GCCACCCTGTCTTTGTCTCCAGGGG<br>AAAGAGCCACCCTCTCCTGCAGGG<br>CCAGTCAGAGTGTTAGCAGCTACT<br>TAGCCTGGTACCAACAGAAACCTG<br>GCCAGGCTCCCAGGCTCCTCATCTA<br>TGATGCATCCAACAGGGCCACTGG<br>CATCCCAGCCAGGTTCAGTGGCAG<br>TGGGTCTGGGACAGACTTCACTCTC<br>ACCATCAGCAGACTGGAGCCTGAA<br>GATTTTGCAGTGTATTACTGTCAGC<br>AGTATGGTAGCTCACTCAGGTACA<br>CTTTTGGCCAGGGGACCAAGCTGG<br>AGATCAAACGTACTGTGGCTGCTC<br>CCTCCGTGTTCATTTTTCCTCCGTC<br>GGACGAACAGCTGAAGTCCGGAAC<br>CGCGTCCGTGGTCTGTCTCCTGAAC<br>AACTTCTATCCGCGCGAGGCGAAA<br>GTGCAGTGGAAGGTCGACAACGCA<br>CTGCAGTCGGGAAACTCCCAGGAA<br>TCGGTGACCGAGCAGGACTCGAAG<br>GACTCAACCTACTCATTGTCCTCCA<br>CCCTCACCCTGAGCAAGGCCGATT<br>ACGAGAAGCATAAGGTCTACGCCT<br>GCGAAGTGACCCACCAGGGCCTGA<br>GCAGCCCAGTGACGAAGTCCTTCA<br>ACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CTACGTACCGGGTGGTGTCCGTGCTG<br>ACCGTGCTGCACCAGGACTGGCTGA<br>ACGGAAAGGAGTACAAGTGCAAAGT<br>GTCAAACAAGGCTCTCCCTGCCCCTA<br>TCGAAAAGACCATCAGCAAGGCCAA<br>GGGTCAACCTAGGGAGCCCCAGGTC<br>TATACTTTGCCGCCTAGCCGGGAAGA<br>AATGACTAAGAACCAAGTGTCCCTG<br>ACTTGCCTTGTCAAGGGCTTTTATCC<br>GTCCGACATCGCCGTGGAGTGGGAG<br>TCCAACGGACAACCGGAGAACAACT<br>ACAAGACCACCCCACCGGTGCTCGA<br>TTCCGATGGCTCCTTCTTCCTGTACTC<br>CAAGCTGACTGTGGACAAGTCAAGA<br>TGGCAGCAGGGAAACGTGTTCTCCTG<br>CTCCGTGATGCACGAAGCGCTGCAC<br>AACCATTACACCCAGAAATCACTGTC<br>ACTTTCGCCGGGAAAA | | |
| SEQ ID<br>1799 | CAGGTGCAGCTACAGCAGTGGGGCG<br>CAGGACTGTTGAAGCCTTCGGAGAC<br>CCTGTCCCTCACCTGCGCTGTCTATG<br>GTGGGTCCTTCAGTGGTTACTACTGG<br>AGCTGGATCCGCCAGCCCCCAGGGA<br>AGGGGCTGGAGTGGATTGGGGAAAT<br>CAATCATAGTGGAAGCACCAACTAC<br>AACCCGTCCCTCAAGAGTCGAGTCAC<br>CATATCAGTAGACACGTCCAAGAAC<br>CAGTTCTCCCTGAAGCTGAGCTCTGT<br>GACCGCCGCGGACACGGCTGTGTATT<br>ACTGTGCGAGAGGCGGTGGTTCGGG<br>GAGTTATTATAAGAGGTTCTTTGACT<br>ACTGGGGCCAGGGAACCCTGGTCAC<br>CGTCTCCTCAGCATCCACCAAGGGGC<br>CTTCCGTGTTCCCCCTGGCCCCTTCAT<br>CCAAGTCGACCTCTGGTGAACCGCC<br>GCACTCGGTTGCCTGGTCAAAGACTA<br>CTTCCCCGAGCCCGTGACTGTCTCGT<br>GGAACTCGGGCGCCCTCACATCCGG<br>AGTGCATACCTTTCCCGCCGTGTTGC<br>AGTCCAGCGGCCTGTACAGCCTGAG<br>CTCCGTCGTGACAGTGCCGTCCTCCT<br>CCCTTGGAACCCAGACCTATATCTGC<br>AACGTCAATCACAAGCCCTCCAACA<br>CCAAAGTGGACAAGAAGGTCGAACC<br>CAAGTCCTGCGACAAGACTCACACCT<br>GTCCGCCTTGTCCAGCCCCTGAGCTG<br>CTGGGTGGTCCGTCCGTGTTCCTCTT<br>CCCGCCCAAGCCGAAGGACACTCTG<br>ATGATTTCACGCACCCCGGAAGTCAC<br>TTGCGTGGTCGTGGACGTGTCGCACG<br>AAGATCCCGAAGTGAAATTCAATTG<br>GTACGTGGATGGGGTCGAAGTGCAC<br>AACGCCAAGACCAAGCCTAGGGAAG<br>AACAGTACAACTCTACGTACCGGGT<br>GGTGTCCGTGCTGACCGTGCTGCACC<br>AGGACTGGCTGAACGGAAAGGAGTA<br>CAAGTGCAAAGTGTCAAACAAGGCT<br>CTCCCTGCCCCTATCGAAAAGACCAT<br>CAGCAAGGCCAAGGGTCAACCTAGG<br>GAGCCCCAGGTCTATACTTTGCCGCC<br>TAGCCGGGAAGAAATGACTAAGAAC<br>CAAGTGTCCCTGACTTGCCTTGTCAA<br>GGGCTTTTATCCGTCCGACATCGCCG<br>TGGAGTGGGAGTCCAACGGACAACC<br>GGAGAACAACTACAAGACCACCCCA<br>CCGGTGCTCGATTCCGATGGCTCCTT<br>CTTCCTGTACTCCAAGCTGACTGTGG<br>ACAAGTCAAGATGGCAGCAGGGAAA<br>CGTGTTCTCCTGCTCCGTGATGCACG<br>AAGCGCTGCACAACCATTACACCCA<br>GAAATCACTGTCACTTTCGCCGGGAA<br>AA | SEQ ID<br>1907 | GAAATTGTGCTGACTCAGTCTCCA<br>GACTCCCTGGCTGTGTCTCTGGGCG<br>AGAGGGCCACCATCAACTGCAAGT<br>CCAGCCAGAGTGTTTTATATGATTC<br>CAACAGTAAGAACTACTTAAGTTG<br>GTATCAGCAGAAACCAGGCCAGCC<br>TCCTAAGTTGCTCATTTCCTGGGCG<br>TCTACCCGGGGGTCCGGGGTCCCT<br>GACCGATTCAGTGGCAGCGGGTCT<br>GGGACAGATTTCACTCTCACCATC<br>AGCAGCCTGCAGGCTGAAGATGTG<br>GCAGTTTATTACTGTCAGCAATTTT<br>ATGGTATTCCCCACTTCGGCCAAG<br>GGACACGACTGGAGATTAAACGTA<br>CTGTGGCTGCTCCCTCCGTGTTCAT<br>TTTTCCTCCGTCGGACGAACAGCTG<br>AAGTCCGGAACCGCGTCCGTGGTC<br>TGTCTCCTGAACAACTTCTATCCGC<br>GCGAGGCGAAAGTGCAGTGGAAG<br>GTCGACAACGCACTGCAGTCGGGA<br>AACTCCCAGGAATCGGTGACCGAG<br>CAGGACTCGAAGGACTCAACCTAC<br>TCATTGTCCTCCACCCTCACCCTGA<br>GCAAGGCCGATTACGAGAAGCATA<br>AGGTCTACGCCTGCGAAGTGACCC<br>ACCAGGGCCTGAGCAGCCCAGTGA<br>CGAAGTCCTTCAACCGGGGAGAAT<br>GC |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| SEQ ID 1800 | GAGGTGCAGCTGGTGCAGTCTGGAG CTGAGGTGAGGAAGCCTGGGGCCTC AGTGAAGGTCTCCTGCAAGGCTTCTG GTTACACATTTACCAGTTATGCCATC AGCTGGGTGCGACAGGCCCCTGGAC AAGGGCTTGAGTGGATGGGGTGGAT CAGCGCTTACGACGGTAACACAAAC TATGCACAGAAGCTCCAGGGCAGAG TCACCATGACCACAGACACATCCAC GAGCACAGCCTACATGGAGGTGAGG AGCCTGAGATCTGACGACACGGCCG TGTATTACTGTGCGAGAGATGGTACG GTCCGAAGGGTAGTGGGAGCTACTA CCCCTGGAAACTTTGACTACAGGGGC CAGGGAACCCTGGTCACCGTCTCCTC AGCATCCACCAAGGGGCCTTCCGTGT TCCCCCTGGCCCCTTCATCCAAGTCG ACCTCTGGTGGAACCGCCGCACTCGG TTGCCTGGTCAAAGACTACTTCCCCG AGCCCGTGACTGTCTCGTGGAACTCG GGCGCCCTCACATCCGGAGTGCATAC CTTTCCCGCCGTGTTGCAGTCCAGCG GCCTGTACAGCCTGAGCTCCGTCGTG ACAGTGCCGTCCTCCTCCCTTGGAAC CCAGACCTATATCTGCAACGTCAATC ACAAGCCCTCCAACACCAAAGTGGA CAAGAAGGTCGAACCCAAGTCCTGC GACAAGACTCACACCTGTCCGCCTTG TCCAGCCCCTGAGCTGCTGGGTGGTC CGTCCGTGTTCCTCTTCCCGCCCAAG CCGAAGGACACTCTGATGATTTCACG CACCCCGGAAGTCACTTGCGTGGTCG TGGACGTGTCGCACGAAGATCCCGA AGTGAAATTCAATTGGTACGTGGATG GGGTCGAAGTGCACAACGCCAAGAC CAAGCCTAGGGAAGAACAGTACAAC TCTACGTACCGGGTGGTGTCCGTGCT GACCGTGCTGCACCAGGACTGGCTG AACGGAAAGGAGTACAAGTGCAAAG TGTCAAACAAGGCTCTCCCTGCCCCT ATCGAAAAGACCATCAGCAAGGCCA AGGGTCAACCTAGGGAGCCCCAGGT CTATACTTTGCCGCCTAGCCGGGAAG AAATGACTAAGAACCAAGTGTCCCT GACTTGCCTTGTCAAGGGCTTTTATC CGTCCGACATCGCCGTGGAGTGGGA GTCCAACGGACAACCGGAGAACAAC TACAAGACCACCCCACCGGTGCTCG ATTCCGATGGCTCCTTCTTCCTGTACT CCAAGCTGACTGTGGACAAGTCAAG ATGGCAGCAGGGAAACGTGTTCTCCT GCTCCGTGATGCACGAAGCGCTGCA CAACCATTACACCCAGAAATCACTGT CACTTTCGCCGGGAAAA | SEQ ID 1908 | GATGTTGTGATGACTCAGTCTCCAG CCACCCTGTCTTTGTCTCCAGGGGA AAGAGCCACCCTCTCCTGCAGGGC CAGTCAGAGTGTTGGTACCAATTT AGCCTGGTACCAGCAGAAACCTGG CCAGGCTCCCAGGCTCCTCATCTAT GATGCATCCAACAGGGCCACTGGC ATCCCAGCCAGGTTCAGTGGCAGT GGGTCTGGGACAGAGTTCACTCTC ACCATCAGCAGCCTGCAGTCTGAA GATTTTGCAGTTTATTACTGTCAGC AGTATAATAACTGGCCTCCGATAA CTTTCGGCGGAGGGACCAAGCTGG AGATCAAACGTACTGTGGCTGCTC CCTCCGTGTTCATTTTTCCTCCGTC GGACGAACAGCTGAAGTCCGGAAC CGCGTCCGTGGTCTGTCTCCTGAAC AACTTCTATCCGCGCGAGGCGAAA GTGCAGTGGAAGGTCGACAACGCA CTGCAGTCGGGAAACTCCCAGGAA TCGGTGACCGAGCAGGACTCGAAG GACTCAACCTACTCATTGTCCTCCA CCCTCACCCTGAGCAAGGCCGATT ACGAGAAGCATAAGGTCTACGCCT GCGAAGTGACCCACCAGGGCCTGA GCAGCCCAGTGACGAAGTCCTTCA ACCGGGGAGAATGC |
| SEQ ID 1801 | GAGGTGCAGCTGGTGCAGTCTGGGG GAGGCGTGGTCCAGCCTGGGAGGTC CCTGAGACTCTCCTGTGCAGCGTCTG GATTCACCTTCAGTAGCTATGGCATG CACTGGGTCCGCCAGGCTCCAGGCA AGGGGCTGGAGTGGGTGGCAGTTAT ATGGTATGATGGAAGTAATAAATAC TATGCAGACTCCGTGAAGGGCCGATT CACCATCTCCAGAGACAATTCCAAG AACACGCTGTATCTGCAAATGAACA GCCTGAGAGCCGAGGACACGGCTGT GTATTACTGTGCGAGAGATCTGAATC GAGGATATTGTAGTGGTGGTAGCTGC TTTTGGCTACTGGGGCCAGGGAACCCT GGTCACCGTCTCCTCAGCATCCACCA AGGGGCCTTCCGTGTTCCCCCTGGCC CCTTCATCCAAGTCGACCTCTGGTGG AACCGCCGCACTCGGTTGCCTGGTCA AAGACTACTTCCCCGAGCCCGTGACT GTCTCGTGGAACTCGGGCGCCCTCAC | SEQ ID 1909 | GATGTTGTGATGACTCAGTCTCCAC TCTCCCTGCCCGTCACCCTTGGACA GCCGGCCTCCATCTCCTGCAGGTCT AGTCAAAGCCTCGTATACAGTGAT GGAAACACCTACTTGAGTTGGCTT CAGCAGAGGCCAGGCCAGCCTCCA AGACTCCTAATTTATAAGATTTCTA ACCGGTTCTCTGGGGTCCCAGACA GATTCAGTGGCAGTGGGCAGGGA CAGATTTCACACTGAAAATCAGCA GGGTGGAAGCTGAGGATGTCGGA TTTATTACTGCATGCAAGGTACACA ATTTCCTCAAACGTTCGGCCAAGG GACCAAGCTGGAGATCAAACGTAC TGTGGCTGCTCCCTCCGTGTTCATT TTTCCTCCGTCGGACGAACAGCTG AAGTCCGGAACCGCGTCCGTGGTC TGTCTCCTGAACAACTTCTATCCGC GCGAGGCGAAAGTGCAGTGGAAG GTCGACAACGCACTGCAGTCGGGA |

TABLE 38-continued

Anti-CLEC2D IgG1 antibody Heavy and Kappa Light Chain DNA sequence

| SEQ ID | VH + CH DNA_IgG1 | SEQ ID | VK + CK DNA |
|---|---|---|---|
| | ATCCGGAGTGCATACCTTTCCCGCCG TGTTGCAGTCCAGCGGCCTGTACAGC CTGAGCTCCGTCGTGACAGTGCCGTC CTCCTCCCTTGGAACCCAGACCTATA TCTGCAACGTCAATCACAAGCCCTCC AACACCAAAGTGGACAAGAAGGTCG AACCCAAGTCCTGCGACAAGACTCA CACCTGTCCGCCTTGTCCAGCCCCTG AGCTGCTGGGTGGTCCGTCCGTGTTC CTCTTCCCGCCCAAGCCGAAGGACAC TCTGATGATTTCACGCACCCCGGAAG TCACTTGCGTGGTCGTGGACGTGTCG CACGAAGATCCCGAAGTGAAATTCA ATTGGTACGTGGATGGGGTCGAAGT GCACAACGCCAAGACCAAGCCTAGG GAAGAACAGTACAACTCTACGTACC GGGTGGTGTCCGTGCTGACCGTGCTG CACCAGGACTGGCTGAACGGAAAGG AGTACAAGTGCAAAGTGTCAAACAA GGCTCTCCCTGCCCCTATCGAAAAGA CCATCAGCAAGGCCAAGGGTCAACC TAGGGAGCCCCAGGTCTATACTTTGC CGCCTAGCCGGGAAGAAATGACTAA GAACCAAGTGTCCCTGACTTGCCTTG TCAAGGGCTTTTATCCGTCCGACATC GCCGTGGAGTGGGAGTCCAACGGAC AACCGGAGAACAACTACAAGACCAC CCCACCGGTGCTCGATTCCGATGGCT CCTTCTTCCTGTACTCCAAGCTGACT GTGGACAAGTCAAGATGGCAGCAGG GAAACGTGTTCTCCTGCTCCGTGATG CACGAAGCGCTGCACAACCATTACA CCCAGAAATCACTGTCACTTTCGCCG GGAAAA | | AACTCCCAGGAATCGGTGACCGAG CAGGACTCGAAGGACTCAACCTAC TCATTGTCCTCCACCCTCACCCTGA GCAAGGCCGATTACGAGAAGCATA AGGTCTACGCCTGCGAAGTGACCC ACCAGGGCCTGAGCAGCCCAGTGA CGAAGTCCTTCAACCGGGGAGAAT GC |
| SEQ ID 1802 | CAGGTGCAGCTGCAGGAGTCTGGGG GAGGCTTGGTACAGCCGGGGGGGTC CCTGAGACTCTCCTGTGCAGCCTCTG GATTCACCTTTAGCAGCTATGCCATG AGCTGGGTCCGCCAGGCTCCAGGGA AGGGGCTGGAGTGGGTTTCATACATT AGTAGTAGTGGTACTACCATATACTA CGCAGACTCTGTGAAGGGCCGATTC ACCGTCTCCAGAGACAATGCCAAGA ACTCACTGTATCTGCAAATGAACAGC CTGAGAGCCGAGGACACGGCCGTGT ATTACTGTGCGAGGGATTATAGCAGC TCGGGGGAGTGCTTTGACTACTGGGG CCAGGGAACCCTGGTCACCGTCTCCT CAGCATCCACCAAGGGGCCTTCCGTG TTCCCCCTGGCCCCTTCATCCAAGTC GACCTCTGGTGGAACCGCCGCACTCG GTTGCCTGGTCAAAGACTACTTCCCC GAGCCCGTGACTGTCTCGTGGAACTC GGGCGCCCTCACATCCGGAGTGCAT ACCTTTCCCGCCGTGTTGCAGTCCAG CGGCCTGTACAGCCTGAGCTCCGTCG TGACAGTGCCGTCCTCCTCCCTTGGA ACCCAGACCTATATCTGCAACGTCAA TCACAAGCCCTCCAACACCAAAGTG GACAAGAAGGTCGAACCCAAGTCCT GCGACAAGACTCACACCTGTCCGCCT TGTCCAGCCCCTGAGCTGCTGGGTGG TCCGTCCGTGTTCCTCTTCCCGCCCA AGCCGAAGGACACTCTGATGATTTCA CGCACCCCGGAAGTCACTTGCGTGGT CGTGGACGTGTCGCACGAAGATCCC GAAGTGAAATTCAATTGGTACGTGG ATGGGGTCGAAGTGCACAACGCCAA GACCAAGCCTAGGGAAGAACAGTAC AACTCTACGTACCGGGTGGTGTCCGT GCTGACCGTGCTGCACCAGGACTGG CTGAACGGAAAGGAGTACAAGTGCA AAGTGTCAAACAAGGCTCTCCCTGCC CCTATCGAAAAGACCATCAGCAAGG | SEQ ID 1910 | GAAATTGTGCTGACTCAGTCTCCA GGCACCCTGTCTTTGTCTCCAGGGG AAAGAGCCACCCTCTCCTGCAGGG CCAGTCAGAGTGTAATAAGCAGGT ACTTAGCCTGGTATCAGCAGAAAC CTGGCCAGGCTCCCAGGCTCCTCAT CCATGGTGCATCCACCAGGGCCAC TGGCATCCCAGACAGGTTCAGTGG CAGTGGGTCTGGGACAGACTTCAC TCTCACCATCAGCAGACTGGAGCC TGAAGACTTTGCAGTGTATTACTGT CAGCAGTATGGTAGCTCACCTCCG TACACTTTTGGCCAGGGGACCAAG GTGGAAATCAAACGTACTGTGGCT GCTCCCTCCGTGTTCATTTTTCCTC CGTCGGACGAACAGCTGAAGTCCG GAACCGCGTCCGTGGTCTGTCTCCT GAACAACTTCTATCCGCGCGAGGC GAAAGTGCAGTGGAAGGTCGACAA CGCACTGCAGTCGGGAAACTCCCA GGAATCGGTGACCGAGCAGGACTC GAAGGACTCAACCTACTCATTGTC CTCCACCCTCACCCTGAGCAAGGC CGATTACGAGAAGCATAAGGTCTA CGCCTGCGAAGTGACCCACCAGGG CCTGAGCAGCCCAGTGACGAAGTC CTTCAACCGGGGAGAATGC |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | CCAAGGGTCAACCTAGGGAGCCCCA<br>GGTCTATACTTTGCCGCCTAGCCGGG<br>AAGAAATGACTAAGAACCAAGTGTC<br>CCTGACTTGCCTTGTCAAGGGCTTTT<br>ATCCGTCCGACATCGCCGTGGAGTGG<br>GAGTCCAACGGACAACCGGAGAACA<br>ACTACAAGACCACCCCACCGGTGCTC<br>GATTCCGATGGCTCCTTCTTCCTGTA<br>CTCCAAGCTGACTGTGGACAAGTCA<br>AGATGGCAGCAGGGAAACGTGTTCT<br>CCTGCTCCGTGATGCACGAAGCGCTG<br>CACAACCATTACACCCAGAAATCACT<br>GTCACTTTCGCCGGGAAAA | | |
| SEQ ID<br>1803 | GAGGTGCAGCTGGTGCAGTCTGGGG<br>GAGGCGTGGTCCAGCCTGGGAGGTC<br>CCTGAGACTCTCCTGTGCAGCGTCTG<br>GATTCACCTTCAGTAGCTATGGCATG<br>CACTGGGTCCGCCAGGCTCCAGGCA<br>AGGGGCTGGAGTGGGTGGCAGTTAT<br>ATGGTATGATGGAAGTAATAAATAC<br>TATGCAGACTCCGTGAAGGGCCGATT<br>CACCATCTCCAGAGACAATTCCAAG<br>AACACGCTGTATCTGCAAATGAACA<br>GCCTGAGAGCCGAGGACACGGCTGT<br>GTATTACTGTGCGAGAGATCAGGCA<br>GCTATGGTAGGCTACTTTGACTACTG<br>GGGCCAGGGAACCCTGGTCACCGTC<br>TCCTCAGCATCCACCAAGGGGCCTTC<br>CGTGTTCCCCCTGGCCCCTTCATCCA<br>AGTCGACCTCTGGTGGAACCGCCGC<br>ACTCGGTTGCCTGGTCAAAGACTACT<br>TCCCCGAGCCCGTGACTGTCTCGTGG<br>AACTCGGGCGCCCTCACATCGGAGT<br>GCATACCTTTCCCGCCGTGTTGCAGT<br>CCAGCGGCCTGTACAGCCTGAGCTCC<br>GTCGTGACAGTGCCGTCCTCCTCCCT<br>TGGAACCCAGACCTATATCTGCAACG<br>TCAATCACAAGCCCTCCAACACCAA<br>AGTGGACAAGAAGGTCGAACCCAAG<br>TCCTGCGACAAGACTCACACCTGTCC<br>GCCTTGTCCAGCCCCTGAGCTGCTGG<br>GTGGTCCGTCCGTGTTCCTCTTCCCG<br>CCCAAGCCGAAGGACACTCTGATGA<br>TTTCACGCACCCCGGAAGTCACTTGC<br>GTGGTCGTGGACGTGTCGCACGAAG<br>ATCCCGAAGTGAAATTCAATTGGTAC<br>GTGGATGGGGTCGAAGTGCACAACG<br>CCAAGACCAAGCCTAGGGAAGAACA<br>GTACAACTCTACGTACCGGGTGGTGT<br>CCGTGCTGACCGTGCTGCACCAGGAC<br>TGGCTGAACGGAAAGGAGTACAAGT<br>GCAAAGTGTCAAACAAGGCTCTCCCT<br>GCCCCTATCGAAAAGACCATCAGCA<br>AGGCCAAGGGTCAACCTAGGGAGCC<br>CCAGGTCTATACTTTGCCGCCTAGCC<br>GGGAAGAAATGACTAAGAACCAAGT<br>GTCCCTGACTTGCCTTGTCAAGGGCT<br>TTTATCCGTCCGACATCGCCGTGGAG<br>TGGGAGTCCAACGGACAACCGGAGA<br>ACAACTACAAGACCACCCCACCGGT<br>GCTCGATTCCGATGGCTCCTTCTTCC<br>TGTACTCCAAGCTGACTGTGGACAAG<br>TCAAGATGGCAGCAGGGAAACGTGT<br>TCTCCTGCTCCGTGATGCACGAAGCG<br>CTGCACAACCATTACACCCAGAAATC<br>ACTGTCACTTTCGCCGGGAAAA | SEQ ID<br>1911 | GACATCCAGTTGACCCAGTCTCCTT<br>CCACCCTGGCTGCATCTGTAGGAG<br>ACAGAGTCACCATCACTTGCCGGG<br>CCAGTCAGAGTATTAGTAGCTGGT<br>TGGCCTGGTATCAGCAGAAACCAG<br>GGAAAGCCCCTAAGGTCCTGATCT<br>ATAAGGCGTCTAGTTTAGAAAGTG<br>GGGTCCCATCAAGGTTCAGCGGCA<br>GTGGATCTGGGACAGAATTCACTC<br>TCACCATCAGCAGCCTGCAGCCTG<br>ATGATTTTGCAACTTATTACTGCCA<br>ACAGTATAATAGTTATTCGGGGAC<br>GTTCGGCCAAGGGACCAAGGTGGA<br>AATCAAACGTACTGTGGCTGCTC<br>CTCCGTGTTCATTTTTCCTCCGTCG<br>GACGAACAGCTGAAGTCCGGAACC<br>GCGTCCGTGGTCTGTCCTGAACA<br>ACTTCTATCCGCGCGAGGCGAAAG<br>TGCAGTGGAAGGTCGACAACGCAC<br>TGCAGTCGGGAAACTCCCAGGAAT<br>CGGTGACCGAGCAGGACTCGAAGG<br>ACTCAACCTACTCATTGTCCTCCAC<br>CCTCACCCTGAGCAAGGCCGATTA<br>CGAGAAGCATAAGGTCTACGCCTG<br>CGAAGTGACCCACCAGGGCCTGAG<br>CAGCCCAGTGACGAAGTCCTTCAA<br>CCGGGGAGAATGC |
| SEQ ID<br>1804 | CAGGTCACCTTGAAGGAGTCTGGGG<br>GAGGCGTGGTCCAGCCTGGGAGGTC<br>CCTGAGACTCTCCTGTGCAGCCTCTG<br>GATTCATCTTCAGTAACTATGCTATA<br>CACTGGGTCCGCCAGGCTCCAGGCA<br>AGGGGCTGGAGTGGGTGGCAGTTAT<br>ATCATATGATGGAAGTAATAAATACT | SEQ ID<br>1912 | GATGTTGTGATGACTCAGTCTCCAG<br>CCATCCTGTCTGTGTCTCCAGGGGA<br>AAGAGCCACCCTCTCCTGCAGGGC<br>CAGTCAGAGTGTTAGTAGCAGCTT<br>AGCCTGGTACCAGCAGAAACCTGG<br>CCAGCCTCCCAGGCTCCTCATCTAT<br>GGTGCCTCCACCAGGGCCACTGCT |

TABLE 38-continued

Anti-CLEC2D IgG1 antibody Heavy and Kappa Light Chain
DNA sequence

| SEQ ID | VH + CH DNA_IgG1 | SEQ ID | VK + CK DNA |
|---|---|---|---|
| | ACGCAGACTCCGTGAAGGGCCGATT<br>CACCATCTCCAGAGACAATTCCAAG<br>AACACGCTGTATCTGCAAATGAACA<br>GCCTGAGAGCTGAGGACACGGCTGT<br>GTATTACTGTGCGAGGACTTTTGCGG<br>GGTATAGCAGCAAACTGGGGTACTT<br>CGATCTCTGGGGCCGTGGCACCCTGG<br>TCACCGTCTCCTCAGCATCCACCAAG<br>GGGCCTTCCGTGTTCCCCCTGGCCCC<br>TTCATCCAAGTCGACCTCTGGTGGAA<br>CCGCCGCACTCGGTTGCCTGGTCAAA<br>GACTACTTCCCCGAGCCCGTGACTGT<br>CTCGTGGAACTCGGGCGCCCTCACAT<br>CCGGAGTGCATACCTTTCCCGCCGTG<br>TTGCAGTCCAGCGGCCTGTACAGCCT<br>GAGCTCCGTCGTGACAGTGCCGTCCT<br>CCTCCCTTGGAACCCAGACCTATATC<br>TGCAACGTCAATCACAAGCCCTCCAA<br>CACCAAAGTGGACAAGAAGGTCGAA<br>CCCAAGTCCTGCGACAAGACTCACA<br>CCTGTCCGCCTTGTCCAGCCCCTGAG<br>CTGCTGGGTGGTCCGTCCGTGTTCCT<br>CTTCCCGCCCAAGCCGAAGGACACTC<br>TGATGATTTCACGCACCCCGGAAGTC<br>ACTTGCGTGGTCGTGGACGTGTCGCA<br>CGAAGATCCCGAAGTGAAATTCAAT<br>TGGTACGTGGATGGGGTCGAAGTGC<br>ACAACGCCAAGACCAAGCCTAGGGA<br>AGAACAGTACAACTCTACGTACCGG<br>GTGGTGTCCGTGCTGACCGTGCTGCA<br>CCAGGACTGGCTGAACGGAAAGGAG<br>TACAAGTGCAAAGTGTCAAACAAGG<br>CTCTCCCTGCCCCTATCGAAAAGACC<br>ATCAGCAAGGCCAAGGGTCAACCTA<br>GGGAGCCCCAGGTCTATACTTTGCCG<br>CCTAGCCGGGAAGAAATGACTAAGA<br>ACCAAGTGTCCCTGACTTGCCTTGTC<br>AAGGGCTTTTATCCGTCCGACATCGC<br>CGTGGAGTGGGAGTCCAACGGACAA<br>CCGGAGAACAACTACAAGACCACCC<br>CACCGGTGCTCGATTCCGATGGCTCC<br>TTCTTCCTGTACTCCAAGCTGACTGT<br>GGACAAGTCAAGATGGCAGCAGGGA<br>AACGTGTTCTCCTGCTCCGTGATGCA<br>CGAAGCGCTGCACAACCATTACACC<br>CAGAAATCACTGTCACTTTCGCCGGG<br>AAAA | | ATCCCAGCCAGGTTCAGTGGCAGT<br>GGGTCTGGGACAGAGTTCACTCTC<br>ACCATCAGCAGCCTGCAGTCTGAA<br>GATTTTGCAGTTTATTACTGTCAGC<br>GCTATGATAACTGGCCTCCCCTTTT<br>TGGCCAGGGGACCAAGCTGGAGAT<br>CAAACGTACTGTGGCTGCTCCCTCC<br>GTGTTCATTTTTCCTCCGTCGGACG<br>AACAGCTGAAGTCCGGAACCGCGT<br>CCGTGGTCTGTCTCCTGAACAACTT<br>CTATCCGCGCGAGGCGAAAGTGCA<br>GTGGAAGGTCGACAACGCACTGCA<br>GTCGGGAAACTCCCAGGAATCGGT<br>GACCGAGCAGGACTCGAAGGACTC<br>AACCTACTCATTGTCCTCCACCCTC<br>ACCCTGAGCAAGGCCGATTACGAG<br>AAGCATAAGGTCTACGCCTGCGAA<br>GTGACCCACCAGGGCCTGAGCAGC<br>CCAGTGACGAAGTCCTTCAACCGG<br>GGAGAATGC |

TABLE 39

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| SEQ ID<br>1913 | EVQLVQSGAEVKKPGASVKVSCKASG<br>YTFTSYAMHWVRQAPGQRLEWMGWI<br>NAGNGNTKYSQKFQGRVTITRDTSAST<br>AYMELSSLRSEDTAVYYCARGSLSRSG<br>WYAGLFDYWGQGTLVTVSSASTKGPS<br>VFPLAPCSRSTSESTAALGCLVKDYFPE<br>PVTVSWNSGALTSGVHTFPAVLQSSGL<br>YSLSSVVTVPSSSLGTKTYTCNVDHKP<br>SNTKVDKRVESKYGPPCPPCPAPEFLG<br>GPSVFLFPPKPKDTLMISRTPEVTCVVV<br>DVSQEDPEVQFNWYVDGVEVHNAKT<br>KPREEQFNSTYRVVSVLTVLHQDWLN<br>GKEYKCKVSNKGLPSSIEKTISKAKGQ<br>PREPQVYTLPPSQEEMTKNQVSLTCLV<br>KGFYPSDIAVEWESNGQPENNYKTTPP<br>VLDSDGSFFLYSRLTVDKSRWQEGNV<br>FSCSVMHEALHNHYTQKSLSLSLGK | SEQ ID<br>2021 | GAAGTGCAGCTGGTGCAGTCTGGGG<br>CTGAGGTGAAGAAGCCTGGGGCCTC<br>AGTGAAGGTTTCCTGCAAGGCTTCT<br>GGATACACCTTCACTAGCTATGCTA<br>TGCATTGGGTGCGCCAGGCCCCCGG<br>ACAAAGGCTTGAGTGGATGGGATG<br>GATCAACGCTGGCAATGGTAACACA<br>AAATATTCACAGAAGTTCCAGGGCA<br>GAGTCACCATTACCAGGGACACATC<br>CGCGAGCACAGCCTACATGGAGCTG<br>AGCAGCCTGAGATCTGAAGACACG<br>GCTGTGTATTACTGTGCGAGAGGCT<br>CCTTGTCCCGAAGTGGCTGGTACGC<br>CGGACTCTTTGACTACTGGGGCCAG<br>GGAACCCTGGTCACCGTCTCCTCAG<br>CATCCACCAAGGGCCCTTCCGTGTT<br>CCCCCTGGCCCCTTGCTCCCGCTCG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACCTCTGAATCCACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1914 | QITLKESGGGVVQPGRSLRLSCAASGF TFSSYSMNWVRQAPGKGLQWVAIISD DGSKSYYADSVQGRFTISRDNSRNTVF LQMNSLRAEDTAMYYCARDRGTKWN QLNDVFDMWGQGTMVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | SEQ ID 2022 | CAGATCACCTTGAAGGAGTCTGGGG GAGGCGTGGTCCAGCCTGGGAGGTC CCTGAGACTCTCCTGTGCAGCCTCT GGATTCACCTTCAGTAGTTATAGCA TGAACTGGGTCCGCCAGGCTCCAGG CAAGGGGCTGCAGTGGGTGGCAATT ATATCAGATGATGGAAGTAAGAGTT ACTACGCAGACTCCGTGCAGGGCCG ATTCACCATCTCCAGAGACAATTCG AGGAACACAGTATTTCTGCAAATGA ACAGCCTGAGAGCTGAGGACACGG CTATGTATTACTGTGCGAGAGACAG GGGAACTAAATGGAACCAATTGAAT GATGTTTTTGATATGTGGGGCCAAG GGACAATGGTCACCGTCTCTTCAGC ATCCACCAAGGGGCCTTCCGTGTTC CCCCTGGCCCCTTGCTCCCGCTCGA CCTCTGAATCCACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1915 | EVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCARGRGYSSS RLYYFDYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2023 | GAAGTGCAGCTGGTGCAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGAGGCC GAGGGTATAGCAGCAGTCGGCTCTA CTACTTTGACTACTGGGGCCAGGGA ACCCTGGTCACCGTCCTCAGCAT CCACCAAGGGGCCTTCCGTGTTCCC CCTGGCCCCTTGCTCCCGCTCGACCT CTGAATCCACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCAAGACCTATACCTGCAACGTC GACCACAAGCCCTCCAACACCAAAG TGGACAAGCGCGTCGAATCCAAGTA CGGCCCCCCTTGTCCGCCTTGTCCA GCCCCTGAGTTCCTGGGTGGTCCGT CCGTGTTCCTCTTCCCGCCCAAGCC GAAGGACACTCTGATGATTTCACGC ACCCCCGGAAGTCACTTGCGTGGTCG TGGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1916 | QVTLKESGGGLVRPGGSLRLSCEASGF TFSDPYMDWVRQAPGKGLEWVGRITN KRTGYATTYAASVKDRFTISRDDSRKS VYLQMNSLKTEDTAVYYCATDVSGSF AAYGGQGTLVTVSSASTKGPSVFPLAP CSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2024 | CAGGTCACCTTGAAGGAGTCTGGGG GAGGCTTGGTCCGGCCTGGAGGGTC CCTGAGACTCTCCTGTGAAGCCTCT GGATTCACCTTCAGTGACCCCTACA TGGACTGGGTCCGCCAGGCTCCAGG CAAGGGGCTGGAGTGGGTTGGCCG AATTACAAATAAGCGTACCGGTTAC GCCACAACATATGCCGCGTCTGTGA AGGACAGATTCACCATCTCAAGAGA TGATTCAAGGAAGTCAGTATATCTG CAAATGAACAGCCTGAAGACCGAG GACACGGCCGTATATTATTGTGCAA CAGATGTCAGTGGGTCCTTCGCGGC CTACGGGGGCCAGGGCACCCTGGTC ACCGTCTCCTCAGCATCCACCAAGG GGCCTTCCGTGTTCCCCCTGGCCCCT TGCTCCCGCTCGACCTCTGAATCCA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCAAGAC CTATACCTGCAACGTCGACCACAAG CCCTCCAACACCAAAGTGGACAAGC GCGTCGAATCCAAGTACGGCCCCCC TTGTCCGCCTTGTCCAGCCCTGAGT TCCTGGGTGGTCCGTCCGTGTTCCTC TTCCCGCCCAAGCCGAAGGACACTC TGATGATTTCACGCACCCCGGAAGT CACTTGCGTGGTCGTGGACGTGTCG CAGGAAGATCCCGAAGTGCAGTTCA ATTGGTACGTGGATGGGGTCGAAGT GCACAACGCCAAGACCAAGCCTAG GGAAGAACAGTTCAACTCTACGTAC CGGGTGGTGTCCGTGCTGACCGTGC TGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1917 | EVQLVQSGGGVVQPGRSLRLSCAASG FTFSSYAMHWVRQAPGQRLEWMGWI NAGNGNTKYSQKFQGRVTITRDTSAST AYMELSSLRSEDTAVYYCAGEGGAVA GTVYWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2025 | GAGGTCCAGCTGGTACAGTCTGGGG GAGGCGTGGTCCAGCCTGGGAGGTC CCTGAGACTCTCCTGTGCAGCGTCT GGATTCACCTTCAGTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATTACCAGGGACACATC CGCGAGCACAGCCTACATGGAGCTG AGCAGCCTGAGATCTGAAGACACG GCTGTGTATTACTGTGCGGGAGAGG GCGGAGCAGTGGCTGGTACTGTCTA CTGGGGCCAGGGAACCCTGGTCACC GTCTCCTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCGGAGTGCATACCTTTCCCGCCGT GTTGCAGTCCAGCGGCCTGTACAGC CTGAGCTCCGTCGTGACAGTGCCGT CCTCCTCCCTTGGAACCAAGACCTA TACCTGCAACGTCGACCACAAGCCC TCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 1918 | QVQLVQSGGGLVKPGGSLRLSCAASG FTFSNAWMSWVRQAPGKGLEWVGRI KSKTDGGTTDYAAPVKGRFTISRDDSK NTLYLQMNSLKTEDTAVYYCTTDEYF YWGQGTLVTVSSASTKGPSVFPLAPCS RSTSESTAALGCLVKDYFPEPVTVSWN SGALTSGVHTFPAVLQSSGLYSLSSVV TVPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2026 | CAGGTCCAGCTGGTGCAGTCTGGGG GAGGCTTGGTAAAGCCTGGGGGGTC CCTTAGACTCTCCTGTGCAGCCTCTG GATTCACTTTCAGTAACGCCTGGAT GAGCTGGGTCCGCCAGGCTCCAGGG AAGGGGCTGGAGTGGGTTGGCCGTA TTAAAAGCAAAACTGATGGTGGGAC AACAGACTACGCTGCACCCGTGAAA GGCAGATTCACCATCTCAAGAGATG ATTCAAAAAACACGCTGTATCTGCA AATGAACAGCCTGAAAACCGAGGA CACAGCCGTGTATTACTGTACCACA GACGAGTATTTCTACTGGGGCCAGG GAACCCTGGTCACCGTCTCCTCAGC ATCCACCAAGGGGCCTTCCGTGTTC CCCCTGGCCCCTTGCTCCCGCTCGA CCTCTGAATCCACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | AAGGCCAAGGGTCAACCTAGGGAG<br>CCCCAGGTCTACACTTTGCCGCCTA<br>GCCAAGAAGAAATGACTAAGAACC<br>AAGTGTCCCTGACTTGCCTTGTCAA<br>GGGCTTTTATCCGTCCGACATCGCC<br>GTGGAGTGGGAGTCCAACGGACAA<br>CCGGAGAACAACTACAAGACCACC<br>CCACCGGTGCTCGATTCCGATGGCT<br>CCTTCTTCCTGTACTCCCGGCTGACT<br>GTGGACAAGTCAAGATGGCAGGAG<br>GGAAACGTGTTCTCCTGCTCCGTGA<br>TGCACGAAGCGCTGCACAACCATTA<br>CACCCAGAAATCACTGTCACTTTCG<br>CTGGGAAAA |
| SEQ ID 1919 | QVQLQQWGAGLLKPSETLSLTCAVYG<br>GSFSGYYWSWIRQPPGKGLEWIGEINH<br>SGSTNYNPSLKSRVTISVDTSKNQFSLK<br>LSSVTAADTAVYYCARVNPGSYTREV<br>SNFDYWGQGTLVTVSSASTKGPSVFPL<br>APCSRSTSESTAALGCLVKDYFPEPVT<br>VSWNSGALTSGVHTFPAVLQSSGLYSL<br>SSVVTVPSSSLGTKTYTCNVDHKPSNT<br>KVDKRVESKYGPPCPPCPAPEFLGGPS<br>VFLFPPKPKDTLMISRTPEVTCVVVDV<br>SQEDPEVQFNWYVDGVEVHNAKTKP<br>REEQFNSTYRVVSVLTVLHQDWLNGK<br>EYKCKVSNKGLPSSIEKTISKAKGQPRE<br>PQVYTLPPSQEEMTKNQVSLTCLVKGF<br>YPSDIAVEWESNGQPENNYKTTPPVLD<br>SDGSFFLYSRLTVDKSRWQEGNVFSCS<br>VMHEALHNHYTQKSLSLSLGK | SEQ ID 2027 | CAGGTGCAGCTACAGCAGTGGGGC<br>GCAGGACTGTTGAAGCCTTCGGAGA<br>CCCTGTCCCTCACCTGCGCTGTCTAT<br>GGTGGGTCCTTCAGTGGTTACTACT<br>GGAGCTGGATCCGCCAGCCCCCAGG<br>GAAGGGGCTGGAGTGGATTGGGGA<br>AATCAATCATAGTGGAAGCACCAAC<br>TACAACCCGTCCCTCAAGAGTCGAG<br>TCACCATATCAGTAGACACGTCCAA<br>GAACCAGTTCTCCCTGAAGCTGAGC<br>TCTGTGACCGCCGCGGACACGGCTG<br>TGTATTACTGTGCGAGAGTAAATCC<br>GGGGAGTTATACGAGGGAGGTGGA<br>CAACTTTGACTACTGGGGCCAGGGA<br>ACCCTGGTGACCGTCTCCTCAGCAT<br>CCACCAAGGGGCCTTCCGTGTTCCC<br>CCTGGCCCCTTGCTCCCGCTGACCT<br>CTGAATCCACCGCCGCACTCGGTTG<br>CCTGGTCAAAGACTACTTCCCCGAG<br>CCCGTGACTGTCTCGTGGAACTCGG<br>GCGCCCTCACATCCGGAGTGCATAC<br>CTTTCCCGCCGTGTTGCAGTCCAGC<br>GGCCTGTACAGCCTGAGCTCCGTCG<br>TGACAGTGCCGTCCTCCTCCCTTGG<br>AACCAAGACCTATACCTGCAACGTC<br>GACCACAAGCCCTCCAACACCAAAG<br>TGGACAAGCGCGTCGAATCCAAGTA<br>CGGCCCCCCTTGTCCGCCTTGTCCA<br>GCCCCTGAGTTCCTGGGTGGTCCGT<br>CCGTGTTCCTCTTCCCGCCCAAGCC<br>GAAGGACACTCTGATGATTTCACGC<br>ACCCCGGAAGTCACTTGCGTGGTCG<br>TGGACGTGTCGCAGGAAGATCCCGA<br>AGTGCAGTTCAATTGGTACGTGGAT<br>GGGGTCGAAGTGCACAACGCCAAG<br>ACCAAGCCTAGGGAAGAACAGTTC<br>AACTCTACGTACCGGGTGGTGTCCG<br>TGCTGACCGTGCTGCACCAGGACTG<br>GCTGAACGGAAAGGAGTACAAGTG<br>CAAAGTGTCAAACAAGGGCCTCCCT<br>TCATCCATCGAAAAGACCATCAGCA<br>AGGCCAAGGGTCAACCTAGGGAGC<br>CCCAGGTCTACACTTTGCCGCCTAG<br>CCAAGAAGAAATGACTAAGAACCA<br>AGTGTCCCTGACTTGCCTTGTCAAG<br>GGCTTTTATCCGTCCGACATCGCCG<br>TGGAGTGGGAGTCCAACGGACAAC<br>CGGAGAACAACTACAAGACCACCC<br>CACCGGTGCTCGATTCCGATGGCTC<br>CTTCTTCCTGTACTCCCGGCTGACTG<br>TGGACAAGTCAAGATGGCAGGAGG<br>GAAACGTGTTCTCCTGCTCCGTGAT<br>GCACGAAGCGCTGCACAACCATTAC<br>ACCCAGAAATCACTGTCACTTTCGC<br>TGGGAAAA |
| SEQ ID 1920 | QVQLQQSGPELVKPSQTLTLTCGISGD<br>SVSSNSVTWNWVRQSPSRGLEWLGRT<br>YYRSQWYYNYAVSVKSRITISPDTSKN<br>QFSLQLNSVTPEDTAVYYCATRGHNY | SEQ ID 2028 | CAGGTACAGCTGCAGCAGTCAGGTC<br>CAGAATTGGTGAAGCCCTCGCAGAC<br>CCTCACACTCACCTGTGGCATCTCC<br>GGGGACAGTGTCTCTAGCAACAGTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | GVDYWGPGTTVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | | TTACTTGGAACTGGGTCAGGCAGTC CCCATCGAGAGGCCTTGAGTGGCTG GGAAGGACTTACTACCGGTCCCAGT GGTATTATAATTATGCGGTGTCTGT GAAAAGTCGAATAACCATCAGCCCA GACACATCCAAGAACCAGTTCTCCC TGCAGTTGAATTCTGTGACTCCCGA GGACACGGCTGTCTATTACTGTGCA ACCAGGGGACATAACTACGGTGTAG ATTACTGGGGCCCGGGGACCACGGT CACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1921 | QVQLVQSGGGLVKPGGSLRLSCAASG FTFSNAWMSWVRQAPGKGLEWVCRI KSKTDGETTDYAAPVKGRFTISRDDSK NTLYLQMNSLKTEDTAVYHCTTGVG WSPFQYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2029 | CAGGTGCAGCTGGTGCAGTCTGGGG GAGGCTTGGTAAAGCCTGGGGGGTC CCTTAGACTCTCCTGTGCAGCCTCTG GATTCACTTTCAGTAACGCCTGGAT GAGCTGGGTCCGCCAGGCTCCAGGG AAGGGGCTGGAGTGGGTTTGCCGTA TTAAAAGCAAAACTGATGGTGAGAC AACAGACTACGCTGCACCCGTGAAA GGCAGATTCACCATCTCAAGAGATG ATTCAAAAAACACGCTGTATCTGCA AATGAACGCCTGAAAACTGAGGA CACAGCCGTGTATCACTGTACCACA GGGGTGGGATGGTCGCCCTTCCAAT ACTGGGGCCAGGGCACCCTGGTCAC CGTCTCCTCAGCATCCACCAAGGGG CCTTCCGTGTTCCCCCTGGCCCCTTG CTCCCGCTCGACCTCTGAATCCACC GCCGCACTCGGTTGCCTGGTCAAAG ACTACTTCCCCGAGCCCGTGACTGT CTCGTGGAACTCGGGCGCCCTCACA TCCGGAGTGCATACCTTTCCCGCCG TGTTGCAGTCCAGCGGCCTGTACAG CCTGAGCTCCGTCGTGACAGTGCCG TCCTCCTCCCTTGGAACCAAGACCT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ATACCTGCAACGTCGACCACAAGCC CTCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 1922 | EVQLVQSGGGLVQPGRSLRLSCTASGF TFGDYAMSWFRQAPGKGLEWVGFIRS KAYGGTTEYAASVKGRFTISRDDSKSI AYLQMNSLKTEDTAVYYCTRDDKIAA AGFTYWYFDLWGRGTLVTVSSASTKG PSVFPLAPCSRSTSESTAALGCLVKDYF PEPVTVSWNSGALTSGVHTFPAVLQSS GLYSLSSVVTVPSSSLGTKTYTCNVDH KPSNTKVDKRVESKYGPPCPPCPAPEF LGGPSVFLFPPKPKDTLMISRTPEVTCV VVDVSQEDPEVQFNWYVDGVEVHNA KTKPREEQFNSTYRVVSVLTVLHQDW LNGKEYKCKVSNKGLPSSIEKTISKAK GQPREPQVYTLPPSQEEMTKNQVSLTC LVKGFYPSDIAVEWESNGQPENNYKT TPPVLDSDGSFFLYSRLTVDKSRWQEG NVFSCSVMHEALHNHYTQKSLSLSLG K | SEQ ID 2030 | GAGGTCCAGCTGGTACAGTCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA GACGACAAAATAGCAGCAGCTGGA TTCACATACTGGTACTTCGATCTCTG GGGCCGTGGCACCCTGGTCACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1923 | QVQLVQSGAEVKKPGASVKVSCKASG YTFAAYYLHWVRQAPGQGLEWMGRI SPGNGVTSYAQKFQGRVTMTGDTSIN TVYMQLNNLISGDTAVYYCAREAADD PFDHWGQGALVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2031 | CAGGTGCAGCTGGTGCAGTCTGGGG CTGAGGTGAAGAAGCCTGGGGCCTC AGTGAAGGTCTCCTGCAAGGCTTCT GGATACACCTTCGCCGCCTATTATTT ACACTGGGTGCGACAGGCCCCTGGA CAAGGCCTTGAGTGGATGGGGCGG ATCAGCCCTGGTAACGGTGTCACAA GTTATGCACAGAAATTTCAGGGCAG AGTCACCATGACCGGGGACACGTCC ATTAACACAGTCTACATGCAACTGA ACAATTTGATTTCTGGCGACACGGC CGTATATTACTGTGCGAGAGAGGCT GCCGACGACCCGTTTGACCATTGGG GCCAGGGAGCCCTGGTCACCGTCTC CTCAGCATCCACCAAGGGGCCTTCC GTGTTCCCCCTGGCCCCTTGCTCCCG CTCGACCTCTGAATCCACCGCCGCA CTCGGTTGCCTGGTCAAAGACTACT TCCCCGAGCCCGTGACTGTCTCGTG GAACTCGGGCGCCCTCACATCCGGA GTGCATACCTTTCCCGCCGTGTTGC AGTCCAGCGGCCTGTACAGCCTGAG CTCCGTCGTGACAGTGCCGTCCTCC TCCCTTGGAACCAAGACCTATACCT GCAACGTCGACCACAAGCCCTCCAA CACCAAAGTGGACAAGCGCGTCGA ATCCAAGTACGGCCCCCCTTGTCCG CCTTGTCCAGCCCCTGAGTTCCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCAGGAA GATCCCGAAGTGCAGTTCAATTGGT ACGTGGATGGGGTCGAAGTGCACA ACGCCAAGACCAAGCCTAGGGAAG AACAGTTCAACTCTACGTACCGGGT GGTGTCCGTGCTGACCGTGCTGCAC CAGGACTGGCTGAACGGAAAGGAG TACAAGTGCAAAGTGTCAAACAAG GGCCTCCCTTCATCCATCGAAAAGA CCATCAGCAAGGCCAAGGGTCAACC TAGGGAGCCCCAGGTCTACACTTTG CCGCCTAGCCAAGAAGAAATGACTA AGAACCAAGTGTCCCTGACTTGCCT TGTCAAGGGCTTTTATCCGTCCGAC ATCGCCGTGGAGTGGGAGTCCAACG GACAACGGAGAACAACTACAAGA CCACCCCACCGGTGCTCGATTCCGA TGGCTCCTTCTTCCTGTACTCCCGGC TGACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 1924 | EVQLVQSGGGVVQPGRSLTLSCAASG FTFSSHLMHWVRQAPGKGLEWVAVIS YDGTSKYYGDSVKGRFTISRDNSKNTL YLQMNSLRAEDTAIYYCAKADYKYD WGQGTLVTVSSASTKGPSVFPLAPCSR STSESTAALGCLVKDYFPEPVTVSWNS GALTSGVHTFPAVLQSSGLYSLSSVVT VPSSSLGTKTYTCNVDHKPSNTKVDK | SEQ ID 2032 | GAAGTGCAGCTGGTGCAGTCTGGGG GAGGCGTGGTCCAGCCTGGGAGGTC CCTGACACTCTCCTGCGCAGCCTCT GGATTCACCTTCAGTTCCCATCTTAT GCACTGGGTCCGCCAGGCTCCAGGC AAGGGGCTGGAGTGGGTGGCAGTT ATATCATATGATGGAACTAGTAAAT ATTACGGAGACTCCGTGAAGGGCCG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
| --- | --- | --- | --- |
| | RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | | CTTCACCATCTCCAGAGACAATTCC AAGAACACGTTGTATCTGCAAATGA ACAGCCTGCGAGCTGAAGACACGG CTATATATTACTGTGCGAAAGCAGA TTATAAATATGACTGGGGCCAGGGA ACCCTGGTCACCGTCTCCTCAGCAT CCACCAAGGGGCCTTCCGTGTTCCC CCTGGCCCCTTGCTCCCGCTCGACCT CTGAATCCACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCAAGACCTATACCTGCAACGTC GACCACAAGCCCTCCAACACCAAAG TGGACAAGCGCGTCGAATCCAAGTA CGGCCCCCCTTGTCCGCCTTGTCCA GCCCCTGAGTTCCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1925 | EVQLVQSGGGLVKPGGSLRLSCTASGF TFGDYAMSWVRQAPGKGLEWVGFIRS KAYGGTTEYAASVKGRFTISRDDSKSI AYLQMNSLKTEDTAVYYCTTHRRPIY DILTGFDYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2033 | GAGGTGCAGCTGGTGCAGTCTGGGG GAGGCTTGGTCAAGCCTGGAGGGTC CCTGAGACTCTCCTGTACAGCTTCT GGATTCACCTTTGGTGATTATGCTAT GAGCTGGGTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACACCGTGTATTACTGTACTACT CATAGACGCCCAATTTACGATATTT TGACTGGTTTTGACTACTGGGGCCA GGGAACCCTGGTCACCGTCTCCTCA GCATCCACCAAGGGGCCTTCCGTGT TCCCCCTGGCCCCTTGCTCCCGCTCG ACCTCTGAATCCACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATACTGTCACTTTCG CTGGGAAAA |
| SEQ ID 1926 | QLQLQESGGGLVQPGRSLRLSCTASGF TFGDYAMSWVRQAPGKGLEWVGFIRS KAYGGTTEYAASVKGRFTISRDDSKSI AYLQMNSLKTEDTAVYYCTREDTMV RGVIPWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2034 | CAGCTGCAGCTGCAGGAGTCCGGGG GAGGCTTGGTACAGCCAGGGCGGTC CCTGAGACTCTCCTGTACAGCTTCT GGATTCACCTTTGGTGATTATGCTAT GAGCTGGGTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA GAGGATACTATGGTTCGGGGAGTTA TTCCCTGGGGCCAGGGAACCCTGGT CACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AAGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CAAGACCACCCCACCGGTGCTCGAT<br>TCCGATGGCTCCTTCTTCCTGTACTC<br>CCGGCTGACTGTGGACAAGTCAAGA<br>TGGCAGGAGGGAAACGTGTTCTCCT<br>GCTCCGTGATGCACGAAGCGCTGCA<br>CAACCATTACACCCAGAAATCACTG<br>TCACTTTCGCTGGGAAAA |
| SEQ ID 1927 | QLQLQESGSGLVKPSQTLSLTCAVSGG<br>SISSGGYSWSWIRQPPGKGLEWIGYIY<br>HSGSTYYNPSLKSRVTISVDRSKNQFSL<br>KLSSVTAADTAVYYCARDRRYYDSSG<br>YYPAYYFDYWGQGTLVTVSSASTKGP<br>SVFPLAPCSRSTSESTAALGCLVKDYFP<br>EPVTVSWNSGALTSGVHTFPAVLQSSG<br>LYSLSSVVTVPSSSLGTKTYTCNVDHK<br>PSNTKVDKRVESKYGPPCPPCPAPEFL<br>GGPSVFLFPPKPKDTLMISRTPEVTCVV<br>VDVSQEDPEVQFNWYVDGVEVHNAK<br>TKPREEQFNSTYRVVSVLTVLHQDWL<br>NGKEYKCKVSNKGLPSSIEKTISKAKG<br>QPREPQVYTLPPSQEEMTKNQVSLTCL<br>VKGFYPSDIAVEWESNGQPENNYKTTP<br>PVLDSDGSFFLYSRLTVDKSRWQEGN<br>VFSCSVMHEALHNHYTQKSLSLSLGK | SEQ ID 2035 | CAGCTGCAGCTGCAGGAGTCCGGCT<br>CAGGACTGGTGAAGCCTTCACAGAC<br>CCTGTCCCTCACCTGCGCTGTCTCTG<br>GTGGCTCCATCAGCAGTGGTGGTTA<br>CTCCTGGAGCTGGATCCGGCAGCCA<br>CCAGGGAAGGGCCTGGAGTGGATT<br>GGGTACATCTATCATAGTGGGAGCA<br>CCTACTACAACCCGTCCCTCAAGAG<br>TCGAGTCACCATATCAGTAGACAGG<br>TCCAAGAACCAGTTCTCCCTGAAGC<br>TGAGCTCTGTGACCGCCGCGGACAC<br>GGCTGTGTATTACTGTGCGAGAGAT<br>CGGCGTTACTATGATAGTAGTGGTT<br>ATTATCCCGCCTACTACTTTGACTAC<br>TGGGGCCAGGGAACCCTGGTCACCG<br>TCTCCTCAGCATCCACCAAGGGGCC<br>TTCCGTGTTCCCCCTGGCCCCTTGCT<br>CCCGCTCGACCTCTGAATCCACCGC<br>CGCACTCGGTTGCCTGGTCAAAGAC<br>TACTTCCCCGAGCCCGTGACTGTCT<br>CGTGGAACTCGGGCGCCCTCACATC<br>CGGAGTGCATACCTTTCCCGCCGTG<br>TTGCAGTCCAGCGGCCTGTACAGCC<br>TGAGCTCCGTCGTGACAGTGCCGTC<br>CTCCTCCCTTGGAACCAAGACCTAT<br>ACCTGCAACGTCGACCACAAGCCCT<br>CCAACACCAAAGTGGACAAGCGCG<br>TCGAATCCAAGTACGGCCCCCCTTG<br>TCCGCCTTGTCCAGCCCCTGAGTTCC<br>TGGGTGGTCCGTCCGTGTTCCTCTTC<br>CCGCCCAAGCCGAAGGACACTCTGA<br>TGATTTCACGCACCCCGGAAGTCAC<br>TTGCGTGGTCGTGGACGTGTCGCAG<br>GAAGATCCCGAAGTGCAGTTCAATT<br>GGTACGTGGATGGGGTCGAAGTGCA<br>CAACGCCAAGACCAAGCCTAGGGA<br>AGAACAGTTCAACTCTACGTACCGG<br>GTGGTGTCCGTGCTGACCGTGCTGC<br>ACCAGGACTGGCTGAACGGAAAGG<br>AGTACAAGTGCAAAGTGTCAAACA<br>AGGGCCTCCCTTCATCCATCGAAAA<br>GACCATCAGCAAGGCCAAGGGTCA<br>ACCTAGGGAGCCCCAGGTCTACACT<br>TTGCCGCCTAGCCAAGAAGAAATGA<br>CTAAGAACCAAGTGTCCCTGACTTG<br>CCTTGTCAAGGGCTTTTATCCGTCCG<br>ACATCGCCGTGGAGTGGGAGTCCAA<br>CGGACAACCGGAGAACAACTACAA<br>GACCACCCCACCGGTGCTCGATTCC<br>GATGGCTCCTTCTTCCTGTACTCCG<br>GCTGACTGTGGACAAGTCAAGATGG<br>CAGGAGGGAAACGTGTTCTCCTGCT<br>CCGTGATGCACGAAGCGCTGCACAA<br>CCATTACACCCAGAAATCACTGTCA<br>CTTTCGCTGGGAAAA |
| SEQ ID 1928 | EVQLVQSGGGLVKPGGSLRLSCAASG<br>FTFSSYSMNWVRQAPGKGLEWVSYIS<br>SSGSYTNYADSVKGRFTISRDNAKNSL<br>YLQINSLRAEDTAIYYCARDGGYDSSG<br>FHFDYWGQGTLVTVSSASTKGPSVFPL<br>APCSRSTSESTAALGCLVKDYFPEPVT<br>VSWNSGALTSGVHTFPAVLQSSGLYSL<br>SSVVTVPSSSLGTKTYTCNVDHKPSNT<br>KVDKRVESKYGPPCPPCPAPEFLGGPS<br>VFLFPPKPKDTLMISRTPEVTCVVVDV<br>SQEDPEVQFNWYVDGVEVHNAKTKP | SEQ ID 2036 | GAAGTCAGCTGGTGCAGTCTGGGG<br>GAGGCCTGGTCAAGCCTGGGGGGTC<br>CCTGAGACTCTCCTGTGCAGCCTCT<br>GGATTCACCTTCAGTAGCTATAGCA<br>TGAACTGGGTCCGCCAGGCTCCAGG<br>GAAGGGCCTGGAGTGGGTTTCATAC<br>ATTAGTAGTAGTGGTAGTTACACAA<br>ACTACGCAGACTCTGTGAAGGGCCG<br>ATTCACCATCTCCAGAGACAACGCC<br>AAGAACTCACTGTATCTGCAAATAA<br>ACAGCCTGAGAGCCGAGGACACG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | | CCATTTATTACTGTGCGAGAGACGG GGGCTATGATAGTAGTGGTTTTCAC TTTGACTACTGGGGCCAGGGAACCC TGGTCACCGTCTCCTCAGCATCCAC CAAGGGGCCTTCCGTGTTCCCCCTG GCCCCTTGCTCCCGCTCGACCTCTG AATCCACCGCCGCACTCGGTTGCCT GGTCAAAGACTACTTCCCCGAGCCC GTGACTGTCTCGTGGAACTCGGGCG CCCTCACATCCGGAGTGCATACCTT TCCCGCCGTGTTGCAGTCCAGCGGC CTGTACAGCCTGAGCTCCGTCGTGA CAGTGCCGTCCTCCTCCCTTGGAAC CAAGACCTATACCTGCAACGTCGAC CACAAGCCCTCCAACACCAAAGTGG ACAAGCGCGTCGAATCCAAGTACGG CCCCCCTTGTCCGCCTTGTCCAGCCC CTGAGTTCCTGGGTGGTCCGTCCGT GTTCCTCTTCCCGCCCAAGCCGAAG GACACTCTGATGATTTCACGCACCC CGGAAGTCACTTGCGTGGTCGTGGA CGTGTCGCAGGAAGATCCCGAAGTG CAGTTCAATTGGTACGTGGATGGGG TCGAAGTGCACAACGCCAAGACCA AGCCTAGGGAAGAACAGTTCAACTC TACGTACCGGGTGGTGTCCGTGCTG ACCGTGCTGCACCAGGACTGGCTGA ACGGAAAGGAGTACAAGTGCAAAG TGTCAAACAAGGGCCTCCCTTCATC CATCGAAAAGACCATCAGCAAGGC CAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1929 | QVQLQQSGPGLVKPSQTLSLTCAISGD SVSNNRAAWNWIRQSPSRGLEWLGRT YYRSKWYNEYAVSVKSRITINPDTSKN QFSLQLNSMTPEDSAVYYCAILPSSGY LQDHHYYGMDVWGQGTTVTVSSAST KGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2037 | CAGGTACAGCTGCAGCAGTCAGGTC CAGGACTGGTGAAGCCCTCGCAGAC CCTCTCACTCACCTGTGCCATCTCCG GGGACAGTGTCTCTAACAACAGGGC TGCTTGGAACTGGATCAGGCAGTCG CCATCGAGAGGCCTTGAGTGGCTGG GAAGGACATACTACAGGTCCAAGTG GTATAATGAATATGCAGTCTCTGTG AAAAGTCGAATAACCATCAACCCAG ACACATCCAAGAACCAGTTCTCCCT GCAGCTGAACTCTATGACTCCCGAG GACTCGGCTGTGTATTACTGTGCAA TTTTGCCTAGTAGTGGTTATCTACAG GACCACCACTACTACGGTATGGACG TCTGGGGCCAAGGGACCACGGTCAC CGTCTCCTCAGCATCCACCAAGGGG CCTTCCGTGTTCCCCCTGGCCCCTTG CTCCCGCTCGACCTCTGAATCCACC GCCGCACTCGGTTGCCTGGTCAAAG ACTACTTCCCCGAGCCCGTGACTGT CTCGTGGAACTCGGGCGCCCTCACA TCCGGAGTGCATACCTTTCCCGCCG TGTTGCAGTCCAGCGGCCTGTACAG CCTGAGCTCCGTCGTGACAGTGCCG TCCTCCTCCCTTGGAACCAAGACCT ATACCTGCAACGTCGACCACAAGCC CTCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCCCGCCCAAGCCGAAGGACACTCT<br>GATGATTTCACGCACCCCGGAAGTC<br>ACTTGCGTGGTCGTGGACGTGTCGC<br>AGGAAGATCCCGAAGTGCAGTTCAA<br>TTGGTACGTGGATGGGGTCGAAGTG<br>CACAACGCCAAGACCAAGCCTAGG<br>GAAGAACAGTTCAACTCTACGTACC<br>GGGTGGTGTCCGTGCTGACCGTGCT<br>GCACCAGGACTGGCTGAACGGAAA<br>GGAGTACAAGTGCAAAGTGTCAAA<br>CAAGGGCCTCCCTTCATCCATCGAA<br>AAGACCATCAGCAAGGCCAAGGGT<br>CAACCTAGGGAGCCCCAGGTCTACA<br>CTTTGCCGCCTAGCCAAGAAGAAAT<br>GACTAAGAACCAAGTGTCCCTGACT<br>TGCCTTGTCAAGGGCTTTTATCCGTC<br>CGACATCGCCGTGGAGTGGGAGTCC<br>AACGGACAACCGGAGAACAACTAC<br>AAGACCACCCCACCGGTGCTCGATT<br>CCGATGGCTCCTTCTTCCTGTACTCC<br>CGGCTGACTGTGGACAAGTCAAGAT<br>GGCAGGAGGGAAACGTGTTCTCCTG<br>CTCCGTGATGCACGAAGCGCTGCAC<br>AACCATTACACCCAGAAATCACTGT<br>CACTTTCGCTGGGAAAA |
| SEQ ID 1930 | EVQLVQSGAEVKKPGASVKVSCKASG<br>YTFTSYGISWVRQAPGQGLEWMGWIS<br>AYNGNTNYAQKLQGRVTMTTDTSTST<br>AYMELSSLRSEDTAVYYCARAAVGDG<br>YSYGRLDWGQGTLVTVSSASTKGPSV<br>FPLAPCSRSTSESTAALGCLVKDYFPEP<br>VTVSWNSGALTSGVHTFPAVLQSSGL<br>YSLSSVVTVPSSSLGTKTYTCNVDHKP<br>SNTKVDKRVESKYGPPCPPCPAPEFLG<br>GPSVFLFPPKPKDTLMISRTPEVTCVVV<br>DVSQEDPEVQFNWYVDGVEVHNAKT<br>KPREEQFNSTYRVVSVLTVLHQDWLN<br>GKEYKCKVSNKGLPSSIEKTISKAKGQ<br>PREPQVYTLPPSQEEMTKNQVSLTCLV<br>KGFYPSDIAVEWESNGQPENNYKTTPP<br>VLDSDGSFFLYSRLTVDKSRWQEGNV<br>FSCSVMHEALHNHYTQKSLSLSLGK | SEQ ID 2038 | GAGGTGCAGCTGGTGCAGTCTGGAG<br>CTGAGGTGAAGAAGCCTGGGGCCTC<br>AGTGAAGGTCTCCTGCAAGGCTTCT<br>GGTTACACCTTTACCAGCTACGGTA<br>TCAGCTGGGTGCGACAGGCCCCTGG<br>ACAAGGGCTTGAGTGGATGGGATG<br>GATCAGCGCTTACAATGGTAACACA<br>AACTATGCACAGAAGCTCCAGGGCA<br>GAGTCACCATGACCACAGACACATC<br>CACGAGCACAGCCTACATGGAGCTG<br>AGCAGCCTGAGATCTGAGGACACG<br>GCCGTGTATTACTGTGCGAGAGCCG<br>CGGTGGGGGATGGATACAGCTATGG<br>TCGGCTCGATTGGGGCCAGGGAACC<br>CTGTCACCGTCTCCTCAGCATCCA<br>CCAAGGGGCCTTCCGTGTTCCCCCT<br>GGCCCCTTGCTCCCGCTCGACCTCT<br>GAATCCACCGCCGCACTCGGTTGCC<br>TGGTCAAAGACTACTTCCCCGAGCC<br>CGTGACTGTCTCGTGGAACTCGGGC<br>GCCCTCACATCCGGAGTGCATACCT<br>TTCCCGCCGTGTTGCAGTCCAGCGG<br>CCTGTACAGCCTGAGCTCCGTCGTG<br>ACAGTGCCGTCCTCCTCCCTTGGAA<br>CCAAGACCTATACCTGCAACGTCGA<br>CCACAAGCCCTCCAACACCAAAGTG<br>GACAAGCGCGTCGAATCCAAGTACG<br>GCCCCCCTTGTCCGCCTTGTCCAGCC<br>CCTGAGTTCCTGGGTGGTCCGTCCG<br>TGTTCCTCTTCCCGCCCAAGCCGAA<br>GGACACTCTGATGATTTCACGCACC<br>CCGGAAGTCACTTGCGTGGTCGTGG<br>ACGTGTCGCAGGAAGATCCCGAAGT<br>GCAGTTCAATTGGTACGTGGATGGG<br>GTCGAAGTGCACAACGCCAAGACC<br>AAGCCTAGGGAAGAACAGTTCAACT<br>CTACGTACCGGGTGGTGTCCGTGCT<br>GACCGTGCTGCACCAGGACTGGCTG<br>AACGGAAAGGAGTACAAGTGCAAA<br>GTGTCAAACAAGGGCCTCCCTTCAT<br>CCATCGAAAAGACCATCAGCAAGG<br>CCAAGGGTCAACCTAGGGAGCCCCA<br>GGTCTACACTTTGCCGCCTAGCCAA<br>GAAGAAATGACTAAGAACCAAGTG<br>TCCCTGACTTGCCTTGTCAAGGGCTT<br>TTATCCGTCCGACATCGCCGTGGAG<br>TGGGAGTCCAACGGACAACCGGAG<br>AACAACTACAAGACCACCCCACCGG<br>TGCTCGATTCCGATGGCTCCTTCTTC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CTGTACTCCCGGCTGACTGTGGACA<br>AGTCAAGATGGCAGGAGGGAAACG<br>TGTTCTCCTGCTCCGTGATGCACGA<br>AGCGCTGCACAACCATTACACCCAG<br>AAATCACTGTCACTTTCGCTGGGAA<br>AA |
| SEQ ID 1931 | EVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARLPSYYYDSS GYFTWYFDLWGRGTLVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | SEQ ID 2039 | GAGGTCCAGCTGGTACAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGACTCCC CTCGTATTACTATGATAGTAGTGGT TACTTTACCTGGTACTTCGATCTCTG GGGCCGTGGCACCCTGGTGACCGTC TCTTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1932 | EVQLVQSGAEVKKPGASVKVSCKASG YTFTSYGISWVRQAPGQGLEWMGWII PIFGIANYAQKFQGRVTITADKSTSTAY MELSSLRSEDTAVYYCARELYNYGSK DYFDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG | SEQ ID 2040 | GAGGTCCAGCTGGTACAGTCTGGAG CTGAGGTGAAGAAGCCTGGGGCCTC AGTGAAGGTCTCCTGCAAGGCTTCT GGTTACACCTTTACCAGCTATGGTA TCAGCTGGGTGCGACAGGCCCCTGG ACAAGGGCTTGAGTGGATGGGATG GATCATCCCTATCTTTGGTATAGCA AACTACGCACAGAAGTTCCAGGGCA GAGTCACGATTACCGCGGACAAATC CACGAGCACAGCCTACATGGAGCTG AGCAGCCTGAGATCTGAGGACACG GCCGTGTATTACTGTGCGAGAGAAC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | | TATACAACTATGGTTCAAAGGACTA CTTTGACTACTGGGGCCAGGGAACC CTGGTCACCGTCTCCTCAGCATCCA CCAAGGGGCCTTCCGTGTTCCCCCT GGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1933 | EVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARGGTWDTAM VTGFPDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2041 | GAAGTGCAGCTGGTGCAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGGGGCGG TACTTGGGATACAGCTATGGTTACG GGCTTTGACTACTGGGGCCAGGGAA CCCTGGTCACCGTCTCCTCAGCATC CACCAAGGGGCCTTCCGTGTTCCCC CTGGCCCCTTGCTCCCGCTCGACCTC TGAATCCACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCAAGACCTATACCTGCAACGTCG ACCACAAGCCCTCCAACACCAAGT GGACAAGCGCGTCGAATCCAAGTAC GGCCCCCCTTGTCCGCCTTGTCCAG CCCCTGAGTTCCTGGGTGGTCCGTC CGTGTTCCTCTTCCCGCCCAAGCCG AAGGACACTCTGATGATTTCACGCA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCCCGGAAGTCACTTGCGTGGTCGT GGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1934 | EVQLVQSGAEVKKPGESLKISCKGSGY SFTSYWIAWVRQMPGKGLEWMGVIYP GDSDTRYSPSFQGQVTISADKSINTAYL QWSSLKASDTAMYYCARPHYDILTGS RAPFDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2042 | GAAGTGCAGCTGGTGCAGTCTGGAG CAGAGGTGAAAAAGCCCGGGGAGT CTCTGAAGATCTCCTGTAAGGGTTC TGGATACAGCTTTACCAGCTACTGG ATCGCCTGGGTGCGCCAGATGCCCG GGAAAGGCCTGGAGTGGATGGGGG TCATCTATCCTGGTGACTCTGATACC AGATACAGCCCGTCCTTCCAAGGCC AGGTCACCATCTCAGCCGACAAGTC CATCAATACCGCCTACCTGCAGTGG AGCAGCCTGAAGGCCTCGGACACCG CCATGTATTACTGTGCGAGACCCCA TTACGATATTTTGACTGGTTCCCGG GCGCCCTTTGACTACTGGGGCCAGG GAACCCTGGTCACCGTCTCCTCAGC ATCCACCAAGGGGCCTTCCGTGTTC CCCCTGGCCCCTTGCTCCCGCTCGA CCTCTGAATCCACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1935 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARARVESKDGYF DYWGQGTLVTVSSASTKGPSVFPLAPC SRSTSESTAALGCLVKDYFPEPVTVSW NSGALTSGVHTFPAVLQSSGLYSLSSV VTVPSSSLGTKTYTCNVDHKPSNTKVD KRVESKYGPPCPPCPAPEFLGGPSVFLF PPKPKDTLMISRTPEVTCVVVDVSQED PEVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2043 | CAGGTGCAGCTACAGCAGTGGGGC GCAGGACTGTTGAAGCCTTCGGAGA CCCTGTCCCTCACCTGCGCTGTCTAT GGTGGGTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGCCCGAGT GGAATCCAAGGATGGGTACTTTGAC TACTGGGGCCAGGGAACCCTGGTCA CCGTCTCCTCAGCATCCACCAAGGG GCCTTCCGTGTTCCCCCTGGCCCCTT GCTCCCGCTCGACCTCTGAATCCAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCGCC GTGTTGCAGTCCAGCGGCCTGTACA GCCTGAGCTCCGTCGTGACAGTGCC GTCCTCCTCCCTTGGAACCAAGACC TATACCTGCAACGTCGACCACAAGC CCTCCAACACCAAAGTGGACAAGCG CGTCGAATCCAAGTACGGCCCCCCT TGTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 1936 | EVQLVESGGGVVQPGRSLRLSCAASGF TFTDAWMNWVRQAPGKGLEWIGRVK NKADGETTDYAAPVKGRITISRDDAK NTLYVQMNSLKTEDTAVYYCTADLRL STWDAYDFWGQGTMVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV | SEQ ID 2044 | GAGGTGCAGCTGGTGGAGTCTGGGG GAGGCGTGGTCCAGCCTGGGAGGTC CCTGAGACTCTCCTGTGCAGCCTCT GGATTCACTTTCACTGATGCCTGGA TGAACTGGGTCCGCCAGGCTCCAGG GAAGGGGCTGGAGTGGATTGGCCGT GTTAAAAACAAAGCTGATGGTGAG ACAACGGACTACGCTGCACCCGTCA AAGGCAGATTCACCATCTCAAGAG ATGATGCAAAGAACACTCTGTATGT GCAAATGAACAGCCTGAAAACCGA GGACACAGCCGTGTATTATTGTACC GCTGACCTGCGACTTTCTACGTGGG ATGCTTATGATTTCTGGGGCCAAGG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | KGFYPSDIAVEWESNGQPENNYKTTPP VLDSDGSFFLYSRLTVDKSRWQEGNV FSCSVMHEALHNHYTQKSLSLSLGK | | GACAATGGTCACCGTCTCTTCAGCA TCCACCAAGGGGCCTTCCGTGTTCC CCCTGGCCCCTTGCTCCCGCTCGAC CTCTGAATCCACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1937 | QITLKESGGGLVQPGGSLRLSCTVSGF TFSNNWMTWVRQTPGKGLEWVANIK QDGTEKHYVDSVKGRFTISRDNAENSL YLQMNSLRGEDTAVYYCARNSQRSFD YWGQGTLVTVSSASTKGPSVFPLAPCS RSTSESTAALGCLVKDYFPEPVTVSWN SGALTSGVHTFPAVLQSSGLYSLSSVV TVPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2045 | CAGATCACCTTGAAGGAGTCTGGGG GAGGCTTGGTCCAGCCTGGGGGGTC CCTAAGACTCTCTTGTACAGTCTCA GGATTCACCTTTAGTAACAATTGGA TGACCTGGGTCCGCCAGACTCCAGG GAAGGGGCTGGAGTGGGTGGCCAA CATAAAGCAAGATGGAACTGAGAA ACACTATGTGGACTCTGTGAAGGGC CGATTCACCATCTCCAGAGACAACG CCGAGAACTCACTGTATCTGCAGAT GAACAGCCTGAGAGGTGAGGACAC GGCCGTGTATTATTGTGCGAGAAAC AGTCAACGTTCGTTTGACTACTGGG GCCAGGGCACCCTGGTGACCGTCTC CTCAGCATCCACCAAGGGGCCTTCC GTGTTCCCCCTGGCCCCTTGCTCCCG CTCGACCTCTGAATCCACCGCCGCA CTCGGTTGCCTGGTCAAAGACTACT TCCCCGAGCCCGTGACTGTCTCGTG GAACTCGGGCGCCCTCACATCCGGA GTGCATACCTTTCCCGCCGTGTTGC AGTCCAGCGGCCTGTACAGCCTGAG CTCCGTCGTGACAGTGCCGTCCTCC TCCCTTGGAACCAAGACCTATACCT GCAACGTCGACCACAAGCCCTCCAA CACCAAAGTGGACAAGCGCGTCGA ATCCAAGTACGGCCCCCCTTGTCCG CCTTGTCCAGCCCCTGAGTTCCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCAGGAA GATCCCGAAGTGCAGTTCAATTGGT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACGTGGATGGGGTCGAAGTGCACA ACGCCAAGACCAAGCCTAGGGAAG AACAGTTCAACTCTACGTACCGGGT GGTGTCCGTGCTGACCGTGCTGCAC CAGGACTGGCTGAACGGAAAGGAG TACAAGTGCAAAGTGTCAAACAAG GGCCTCCCTTCATCCATCGAAAAGA CCATCAGCAAGGCCAAGGGTCAACC TAGGGAGCCCCAGGTCTACACTTTG CCGCCTAGCCAAGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCCGGC TGACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 1938 | QVTLKESGGGVVQPGRSLRLSCAASGF TFSSYGMHWVRQAPGKGLEWVAVISY DGSNKYYADSVKGRFTISRDNSKNTL YLQMNSLRAEDTAVYYCAKDLGDPR GGILNYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2046 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGGCA TGCACTGGGTCCGCCAGGCTCCAGG CAAGGGCCTGGAGTGGGTGGCAGTT ATATCATATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAAGATTT AGGGGATCCCGGGGTGGTATTTTG AACTACTGGGGCCAGGGCACCCTGG TCACCGTCTCCTCAGCATCCACCAA GGGGCCTTCCGTGTTCCCCCTGGCC CCTTGCTCCCGCTCGACCTCTGAATC CACCGCCGCACTCGGTTGCCTGGTC AAAGACTACTTCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GCTCCGTGATGCACGAAGCGCTGCA CAACCATTACACCCAGAAATCACTG TCACTTTCGCTGGGAAAA |
| SEQ ID 1939 | EVQLVESGGGVVQPGRSLRLSCAASGF TFSSYAMHWVRQAPGKGLEWVAVISY DGSNKYYADSVKGRFTISRDNSKNTL YLQMNSLRAEDTAVYYCARSSPWGEL SLYQGAFDIWGQGTMVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | SEQ ID 2047 | GAGGTGCAGCTGGTGGAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCCCGGTCGAG CCCCTGGGGGAGTTATCGTTATAC CAGGGGGCTTTTGATATCTGGGGCC AAGGGACAATGGTCACCGTCTCTTC AGCACTCACCAAGGGGCCTTCCGTG TTCCCCCTGGCCCCTTGCTCCCGCTC GACCTCTGAATCCACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCAAGACCTATACCTGCAA CGTCGACCACAAGCCCTCCAACACC AAAGTGGACAAGCGCGTCGAATCC AAGTACGGCCCCCCTTGTCCGCCTT GTCCAGCCCCTGAGTTCCTGGGTGG TCCGTCCGTGTTCCTCTTCCCGCCCA AGCCGAAGGACACTCTGATGATTTC ACGCACCCCGGAAGTCACTTGCGTG GTCGTGGACGTGTCGCAGGAAGATC CCGAAGTGCAGTTCAATTGGTACGT GGATGGGGTCGAAGTGCACAACGC CAAGACCAAGCCTAGGGAAGAACA GTTCAACTCTACGTACCGGGTGGTG TCCGTGCTGACCGTGCTGCACCAGG ACTGGCTGAACGGAAAGGAGTACA AGTGCAAAGTGTCAAACAAGGGCCT CCCTTCATCCATCGAAAAGACCATC AGCAAGGCCAAGGGTCAACCTAGG GAGCCCCAGGTCTACACTTTGCCGC CTAGCCAAGAAGAAATGACTAAGA ACCAAGTGTCCCTGACTTGCCTTGT CAAGGGCTTTTATCCGTCCGACATC GCCGTGGAGTGGGAGTCCAACGGA CAACCGGAGAACAACTACAAGACC ACCCCACCGGTGCTCGATTCCGATG GCTCCTTCTTCCTGTACTCCCGGCTG ACTGTGGACAAGTCAAGATGGCAG GAGGGAAACGTGTTCTCCTGCTCCG TGATGCACGAAGCGCTGCACAACCA TTACACCCAGAAATCACTGTCACTT TCGCTGGGAAAA |
| SEQ ID 1940 | QITLKESGGGLVQPGRSLRLSCAASGF TFDDYAMHWVRQAPGKGLEWVSAIS GSGGSTYYADSVKGRFTISRDNSKNTL YLQMNSLRAEDTAVYYCAKDNDFWS GKVFDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV | SEQ ID 2048 | CAGATCACCTTGAAGGAGTCTGGGG GAGGCTTGGTCCAGCCTGGCAGGTC CCTGAGACTCTCCTGTGCAGCCTCT GGATTCACCTTTGATGATTATGCCA TGCACTGGGTCCGGCAAGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGATAA CGATTTTTGGAGTGGGAAAGTCTTT GACTACTGGGGCCAGGGCACCCTGG TCACCGTCTCCTCAGCATCCACCAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | LDSDGSFFLYSRLTVDKSRWQEGNVFS CSVMHEALHNHYTQKSLSLSLGK | | GGGGCCTTCCGTGTTCCCCCTGGCC CCTTGCTCCCGCTCGACCTCTGAATC CACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1941 | EVQLVQSGGGLVQPGGSLRLSCAASG FTFSSYSMNWVRQAPGKGLEWVSYIS STSSTIYYADSVKGRFTISRDNSKNMLF LQMNSLRAEDTAVYYCAKEGGSGWR HYFDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2049 | GAAGTGCAGCTGGTGCAGTCTGGGG GAGGCTTGGTACAGCCTGGGGGGTC CCTGAGACTCTCCTGTGCAGCCTCT GGATTCACCTTCAGTAGTTATAGCA TGAACTGGGTCCGCCAGGCTCCAGG GAAGGGGCTGGAGTGGGTTTCATAC ATCAGTAGTACTAGTAGTACCATAT ACTACGCAGACTCCGTGAAGGGCCG ATTCACCATCTCCAGAGACAATTCC AAGAATATGCTGTTTCTACAAATGA ACAGCCTGAGAGCTGAGGACACGG CTGTGTATTACTGTGCGAAAGAAGG GGGCAGTGGCTGGCGCCACTACTTT GACTACTGGGGCCAGGGAACCCTGG TCACCGTCTCCTCAGCATCCACCAA GGGGCCTTCCGTGTTCCCCCTGGCC CCTTGCTCCCGCTCGACCTCTGAATC CACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1942 | QVTLKESGGGVVQPGRSLRLSCAASGF TFSSYAMHWVRQAPGKGLEWVAVISY DGSNKYYADSVKGRFTISRDNSKNTL YLQMNSLRAEDTAVYYCARDYCSSTS CQNWFDPWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2050 | CAGGTCACCTTGAAGGAGTCTGGGG GAGGCGTGGTCCAGCCTGGGAGGTC CCTGAGACTGTCCTGTGCAGCCTCT GGATTCACCTTCAGCAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGAGATTA TTGTAGTAGTACCAGCTGCCAGAAC TGGTTCGACCCCTGGGGCCAGGGCA CCCTGGTCACCGTCTCCTCAGCATC CACCAAGGGGCCTTCCGTGTTCCCC CTGGCCCCTTGCTCCCGCTCGACCTC TGAATCCACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCAAGACCTATACCTGCAACGTCG ACCACAAGCCCTCCAACACCAAAGT GGACAAGCGCGTCGAATCCAAGTAC GGCCCCCCTTGTCCGCCTTGTCCAG CCCCTGAGTTCCTGGGTGGTCCGTC CGTGTTCCTCTTCCCGCCCAAGCCG AAGGACACTCTGATGATTTCACGCA CCCCCGGAAGTCACTTGCGTGGTCGT GGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1943 | QVQLVQSGGGLVQPGGSLRLSCAASG FTFSNYVMSWVRQAPGKGLEWVSAIS GIGDTTYYADSVKGRFTISRDNAKNTL YLQMNSLRAEDTAVYYCARGRVAGD AFDIWGQGTMVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2051 | CAGGTCCAGCTGGTGCAGTCTGGGG GAGGCTTGGTACAGCCTGGGGGGTC CCTGAGACTCTCCTGTGCAGCCTCT GGATTCACCTTTAGCAACTATGTCA TGAGCTGGGTCCGCCAGGCTCCAGG GAAGGGGCTGGAGTGGGTCTCAGCT ATTAGTGGTATTGGTGATACTACAT ACTACGCGGACTCCGTGAAGGGCCG ATTCACCATCTCCAGAGACAACGCC AAGAACACGCTGTATCTGCAAATGA ACAGTCTGAGAGCCGAGGACACGG CTGTGTATTACTGTGCAAGAGGGCG CGTGGCGGGGGATGCTTTTGATATC TGGGGCCAAGGGACAATGGTGACC GTCTCTTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCAAGACCTA TACCTGCAACGTCGACCACAAGCCC TCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 1944 | QLQLQESGGGLVQPGGSLRLSCAASGF TFSSYAMSWVRQAPGKGLEWVSAISG SGGSTYYADSVKGRFTISRDNSKNTLY LQMNSLRAEDTAVYYCAKDQGAAAG TLGYFDYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2052 | CAGCTGCAGCTGCAGGAGTCGGGG GGAGGCTTGGTACAGCCTGGGGGGT CCCTGAGACTCTCCTGTGCAGCCTC TGGATTCACCTTTAGCAGCTATGCC ATGAGCTGGGTCCGCCAGGCTCCAG GGAAGGGGCTGGAGTGGGTCTCAG CTATTAGTGGTAGTGGTGGTAGCAC ATACTACGCAGACTCCGTGAAGGGC CGGTTCACCATCTCCAGAGACAATT CCAAGAACACGCTGTATCTGCAAAT GAACAGCCTGAGAGCCGAGGACAC GGCCGTATATTACTGTGCGAAAGAT CAAGGGGCAGCAGCTGGTACCCTGG GGTACTTTGACTACTGGGGCCAGGG AACCCTGGTGACCGTCTCCTCAGCA TCCACCAAGGGGCCTTCCGTGTTCC CCCTGGCCCCTTGCTCCCGCTCGAC CTCTGAATCCACCGCCGCACTCGGT TGCCTGGTCAAAGACTACTTCCCCG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | AGCCCGTGACTGTCTCGTGGAACTC
GGGCGCCCTCACATCCGGAGTGCAT
ACCTTTCCCGCCGTGTTGCAGTCCA
GCGGCCTGTACAGCCTGAGCTCCGT
CGTGACAGTGCCGTCCTCCTCCCTT
GGAACCAAGACCTATACCTGCAACG
TCGACCACAAGCCCTCCAACACCAA
AGTGGACAAGCGCGTCGAATCCAA
GTACGGCCCCCCTTGTCCGCCTTGTC
CAGCCCCTGAGTTCCTGGGTGGTCC
GTCCGTGTTCCTCTTCCCGCCCAAGC
CGAAGGACACTCTGATGATTTCACG
CACCCCGGAAGTCACTTGCGTGGTC
GTGGACGTGTCGCAGGAAGATCCCG
AAGTGCAGTTCAATTGGTACGTGGA
TGGGGTCGAAGTGCACAACGCCAA
GACCAAGCCTAGGGAAGAACAGTT
CAACTCTACGTACCGGGTGGTGTCC
GTGCTGACCGTGCTGCACCAGGACT
GGCTGAACGGAAAGGAGTACAAGT
GCAAAGTGTCAAACAAGGGCCTCCC
TTCATCCATCGAAAAGACCATCAGC
AAGGCCAAGGGTCAACCTAGGGAG
CCCCAGGTCTACACTTTGCCGCCTA
GCCAAGAAGAAATGACTAAGAACC
AAGTGTCCCTGACTTGCCTTGTCAA
GGGCTTTTATCCGTCCGACATCGCC
GTGGAGTGGGAGTCCAACGGACAA
CCGGAGAACAACTACAAGACCACC
CCACCGGTGCTCGATTCCGATGGCT
CCTTCTTCCTGTACTCCCGGCTGACT
GTGGACAAGTCAAGATGGCAGGAG
GGAAACGTGTTCTCCTGCTCCGTGA
TGCACGAAGCGCTGCACAACCATTA
CACCCAGAAATACTGTCACTTTCG
CTGGGAAAA |
| SEQ ID 1945 | QVQLVQSGAEVKKPGASVKVSCKASG
YTFTSYDINWVRQATGQGLEWMGWM
NPNSGNTGYAQKFQGRVTMTRNTSIST
AYMELSSLRSEDTAVYYCTRGIYDSSG
SSNPFDSWGQGTLVTVSSASTKGPSVF
PLAPCSRSTSESTAALGCLVKDYFPEPV
TVSWNSGALTSGVHTFPAVLQSSGLYS
LSSVVTVPSSSLGTKTYTCNVDHKPSN
TKVDKRVESKYGPPCPPCPAPEFLGGP
SVFLFPPKPKDTLMISRTPEVTCVVVD
VSQEDPEVQFNWYVDGVEVHNAKTK
PREEQFNSTYRVVSVLTVLHQDWLNG
KEYKCKVSNKGLPSSIEKTISKAKGQP
REPQVYTLPPSQEEMTKNQVSLTCLVK
GFYPSDIAVEWESNGQPENNYKTTPPV
LDSDGSFFLYSRLTVDKSRWQEGNVFS
CSVMHEALHNHYTQKSLSLSLGK | SEQ ID 2053 | CAGGTGCAGCTGGTGCAGTCTGGGG
CTGAGGTGAAGAAGCCTGGGGCCTC
AGTGAAGGTCTCCTGCAAGGCTTCT
GGATACACCTTCACCAGTTATGATA
TCAACTGGGTGCGACAGGCCACTGG
ACAAGGGCTTGAGTGGATGGGATG
GATGAACCCTAACAGTGGTAACACA
GGCTATGCACAGAAGTTCCAGGGCA
GAGTCACCATGACCAGGAACACCTC
CATAAGCACAGCCTACATGGAGCTG
AGCAGCCTGAGATCTGAGGACACG
GCCGTGTATTACTGTACGAGAGGAA
TCTATGATAGTAGTGGTTCTTCCAAT
CCCTTTGACTCCTGGGGCCAGGGAA
CCCTGGTGACCGTCTCCTCAGCATC
CACCAAGGGGCCTTCCGTGTTCCCC
CTGGCCCCTTGCTCCCGCTCGACCTC
TGAATCCACCGCCGCACTCGGTTGC
CTGGTCAAAGACTACTTCCCCGAGC
CCGTGACTGTCTCGTGGAACTCGGG
CGCCCTCACATCCGGAGTGCATACC
TTTCCCGCCGTGTTGCAGTCCAGCG
GCCTGTACAGCCTGAGCTCCGTCGT
GACAGTGCCGTCCTCCTCCCTTGGA
ACCAAGACCTATACCTGCAACGTCG
ACCACAAGCCCTCCAACACCAAAGT
GGACAAGCGCGTCGAATCCAAGTAC
GGCCCCCCTTGTCCGCCTTGTCCAG
CCCCTGAGTTCCTGGGTGGTCCGTC
CGTGTTCCTCTTCCCGCCCAAGCCG
AAGGACACTCTGATGATTTCACGCA
CCCCGGAAGTCACTTGCGTGGTCGT
GGACGTGTCGCAGGAAGATCCCGA
AGTGCAGTTCAATTGGTACGTGGAT
GGGGTCGAAGTGCACAACGCCAAG
ACCAAGCCTAGGGAAGAACAGTTC
AACTCTACGTACCGGGTGGTGTCCG
TGCTGACCGTGCTGCACCAGGACTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1946 | EVQLVQSGAEVKKPGASVKISCEASGY TFTDYAIHWVRQAPGQRLEWMGWIN AGDGGTKSSREFQGRVTITRDTSATTA YMEVSSLRSEDTAVYYCARGYCSGGS CPGTDFDYWGQGTLVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2054 | GAGGTGCAGCTGGTGCAGTCTGGGG CTGAGGTGAAGAAGCCTGGGGCCTC AGTGAAGATTTCCTGCGAGGCTTCT GGATACACCTTCACTGATTATGCTA TACATTGGGTGCGCCAGGCCCCCGG ACAAAGACTTGAGTGGATGGGATG GATCAACGCTGGCGATGGTGGCACA AAAAGTTCACGGGAGTTCCAGGGCA GAGTCACCATTACCAGGGACACATC CGCGACCACAGCCTACATGGAGGTG AGCAGTCTGAGATCTGAAGACACGG CTGTCTATTACTGTGCGAGAGGATA TTGTAGTGGTGGTAGCTGCCCAGGA ACGGATTTTGACTACTGGGGCCAGG GAACCCTGGTCACCGTCTCCTCAGC ATCCACCAAGGGGCCTTCCGTGTTC CCCCTGGCCCCTTGCTCCCGCTCGA CCTCTGAATCCACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1947 | QVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCARDGVGGRD GYNFDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2055 | CAGGTGCAGCTGGTGCAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGAGATG GTGTAGGAGGGAGAGATGGCTACA ATTTTGACTACTGGGGCCAGGGAAC CCTGGTCACCGTCTCCTCAGCATCC ACCAAGGGGCCTTCCGTGTTCCCCC TGGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAGTG GACAAGCGCGTCGAATCCAAGTACG GCCCCCCTTGTCCGGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTCCG GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1948 | EVQLVQSGGGLVQPGGSLRLSCAASG FTVSSNYMSWVRQAPGKGLEWVSVIY SGGSTYYADSVKGRFTISRDNSKNTLY LQMNSLRAEDTAVYYCARAPLAADG YFDYWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2056 | GAAGTGCAGCTGGTGCAGTCTGGGG GAGGCTTGGTCCAGCCTGGGGGGTC CCTGAGACTCTCCTGTGCAGCCTCT GGATTCACCGTCAGTAGCAACTACA TGAGCTGGGTCCGCCAGGCTCCAGG GAAGGGGCTGGAGTGGGTCTCAGTT ATTTATAGCGGTGGTAGCACATACT ACGCAGACTCCGTGAAGGGCCGATT CACCATCTCCAGAGACAATTCCAAG AACACGCTGTATCTTCAAATGAACA GCCTGAGAGCTGAGGACACGGCTGT GTATTACTGTGCGAGAGCCCCCCTA GCAGCAGATGGCTACTTTGACTACT GGGGCCAGGGAACCCTGGTCACCGT CTCCTCAGCATCCACCAAGGGGCCT TCCGTGTTCCCCCTGGCCCCTTGCTC CCGCTCGACCTCTGAATCCACCGCC GCACTCGGTTGCCTGGTCAAAGACT ACTTCCCCGAGCCCGTGACTGTCTC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCAAGACCTATA CCTGCAACGTCGACCACAAGCCCTC CAACACCAAAGTGGACAAGCGCGT CGAATCCAAGTACGGCCCCCCCTTGT CCGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1949 | EVQLVQSGAEVKKPGSSVKVSCKASG GTFSSYAISWVRQAPGQGLEWMGGIIP IFGTANYAQKFQGRVTITADESTSTAY MELSSLRSEDTAVYYCARARGLQYLI WYFDLWGRGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2057 | GAGGTCCAGCTGGTGCAGTCTGGGG CTGAGGTGAAGAAGCCTGGGTCCTC GGTGAAGGTCTCCTGCAAGGCTTCT GGAGGCACCTTCAGCAGCTATGCTA TCAGCTGGGTGCGACAGGCCCCTGG ACAAGGGCTTGAGTGGATGGGAGG GATCATCCCTATCTTTGGTACAGCA AACTACGCACAGAAGTTCCAGGGCA GAGTCACGATTACCGCGGACGAATC CACGAGCACAGCCTACATGGAGCTG AGCAGCCTGAGATCTGAGGACACG GCCGTGTATTACTGTGCGAGAGCCC GGGGGCTACAGTACCTAATCTGGTA CTTCGATCTCTGGGGCCGTGGCACC CTGGTGACCGTCTCCTCAGCATCCA CCAAGGGGCCTTCCGTGTTCCCCCT GGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA |

TABLE 39-continued

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| | | | GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1950 | QVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCASPGMVRGV ITAPLDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2058 | CAGGTCCAGCTGGTACAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGCCCGG GTATGGTTCGGGGAGTTATTACTGC CCCGCTTGACTACTGGGGCCAGGGC ACCCTGGTCACCGTCTCCTCAGCAT CCACCAAGGGGCCTTCCGTGTTCCC CCTGGCCCCTTGCTCCCGCTCGACCT CTGAATCCACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCAAGACCTATACCTGCAACGTC GACCACAAGCCCTCCAACACCAAAG TGGACAAGCGCGTCGAATCCAAGTA CGGCCCCCCTTGTCCGCCTTGTCCA GCCCCTGAGTTCCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |

TABLE 39-continued

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| SEQ ID 1951 | EVQLVQSGGGLVKPGGSLRLSCAASG FTFSSYAISWVRQAPGQGLEWMGGIIP MYGTANYAQKFQGRVTITADESTSTA YMELSSLRSEDTALYYCAREAKWGM YYFDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2059 | GAGGTCCAGCTGGTACAGTCTGGGG GAGGCCTGGTCAAGCCTGGGGGGTC CCTGAGACTCTCCTGTGCAGCCTCT GGATTCACCTTCAGCAGCTATGCTA TCAGCTGGGTGCGACAGGCCCCTGG ACAAGGGCTTGAGTGGATGGGAGG GATCATCCCTATGTATGGTACAGCA AACTACGCACAGAAGTTCCAGGGCA GAGTCACGATTACCGCGGACGAATC CACGAGCACAGCCTACATGGAACTG AGCAGCCTGAGATCTGAGGACACG GCCCTCTATTACTGTGCGAGAGAAG CTAAGTGGGGAATGTACTACTTTGA CTACTGGGGCCAGGGCACCCTGGTC ACCGTCTCCTCAGCATCCACCAAGG GGCCTTCCGTGTTCCCCCTGGCCCCT TGCTCCCGCTCGACCTCTGAATCCA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCAAGAC CTATACCTGCAACGTCGACCACAAG CCCTCCAACACCAAAGTGGACAAGC GCGTCGAATCCAAGTACGGCCCCCC TTGTCCGCCTTGTCCAGCCCCTGAGT TCCTGGGTGGTCCGTCCGTGTTCCTC TTCCCGCCCAAGCCGAAGGACACTC TGATGATTTCACGCACCCCGGAAGT CACTTGCGTGGTCGTGGACGTGTCG CAGGAAGATCCCGAAGTGCAGTTCA ATTGGTACGTGGATGGGGTCGAAGT GCACAACGCCAAGACCAAGCCTAG GGAAGAACAGTTCAACTCTACGTAC CGGGTGGTGTCCGTGCTGACCGTGC TGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1952 | EVQLVESGGGVVQPGRSLRLSCAASGF TFSSYAIHWVRQAPGKGLEWVAIISDD GSKSYYADSVQGRFTISRDNSRNTVYL QMNSLRAEDTAMYYCARDRGTKWNQ LNDVFDMWGQGTMVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2060 | GAGGTGCAGCTGGTGGAGTCCGGG GGAGGCGTGGTCCAGCCTGGGAGGT CCCTGAGACTCTCCTGTGCAGCCTC TGGATTCACCTTCAGTAGCTATGCT ATACACTGGGTCCGCCAGGCTCCAG GCAAGGGGCTGGAGTGGGTGGCAA TTATATCAGATGATGGAAGTAAGAG TTACTACGCAGACTCCGTGCAGGGC CGATTCACCATCTCCAGAGACAATT CGAGGAACACAGTATATCTGCAAAT GAACAGCCTGAGAGCTGAGGACAC GGCTATGTATTACTGTGCGAGAGAC AGGGGAACTAAATGGAACCAATTG AATGATGTTTTTGATATGTGGGGCC AAGGGACAATGGTCACCGTCTCTTC AGCATCCACCAAGGGCCCTTCCGTG TTCCCCCTGGCCCCTTGCTCCCGCTC GACCTCTGAATCCACCGCCGCACTC GGTTGCCTGGTCAAAGACTACTTCC CCGAGCCCGTGACTGTCTCGTGGAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCAAGACCTATACCTGCAA CGTCGACCACAAGCCCTCCAACACC AAAGTGGACAAGCGCGTCGAATCC AAGTACGGCCCCCCTTGTCCGCCTT GTCCAGCCCCTGAGTTCCTGGGTGG TCCGTCCGTGTTCCTCTTCCCGCCCA AGCCGAAGGACACTCTGATGATTTC ACGCACCCCGGAAGTCACTTGCGTG GTCGTGGACGTGTCGCAGGAAGATC CCGAAGTGCAGTTCAATTGGTACGT GGATGGGGTCGAAGTGCACAACGC CAAGACCAAGCCTAGGGAAGAACA GTTCAACTCTACGTACCGGGTGGTG TCCGTGCTGACCGTGCTGCACCAGG ACTGGCTGAACGGAAAGGAGTACA AGTGCAAAGTGTCAAACAAGGGCCT CCCTTCATCCATCGAAAAGACCATC AGCAAGGCCAAGGGTCAACCTAGG GAGCCCCAGGTCTACACTTTGCCGC CTAGCCAAGAAGAAATGACTAAGA ACCAAGTGTCCCTGACTTGCCTTGT CAAGGGCTTTTATCCGTCCGACATC GCCGTGGAGTGGGAGTCCAACGGA CAACCGGAGAACAACTACAAGACC ACCCCACCGGTGCTCGATTCCGATG GCTCCTTCTTCCTGTACTCCCGGCTG ACTGTGGACAAGTCAAGATGGCAG GAGGGAAACGTGTTCTCCTGCTCCG TGATGCACGAAGCGCTGCACAACCA TTACACCCAGAAATCACTGTCACTT TCGCTGGGAAAA |
| SEQ ID 1953 | QMQLVQSGAEVKKPGASVKVSCTASG YTFTSSDINWVRQATGQGLEWMGWM NPNSGNTGYAEKFQGRVTMTSDSSIST AYMELRSLTTEDTAVYYCARGGGASY TDSWGQGTLVTVSSASTKGPSVFPLAP CSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2061 | CAGATGCAGCTGGTGCAATCTGGGG CTGAGGTGAAGAAGCCTGGGGCCTC AGTGAAGGTCTCCTGCACGGCTTCT GGATACACCTTCACCAGTTCTGATA TCAACTGGGTGCGACAGGCCACTGG ACAAGGGCTTGAGTGGATGGGATG GATGAACCCTAACAGTGGTAACACC GGCTATGCAGAGAAGTTCCAGGGCA GGGTCACCATGACCAGCGACTCCTC CATAAGCACCGCCTACATGGAGTTG AGAAGCCTGACCACTGAGGACACG GCCGTATATTACTGTGCGAGAGGTG GGGGTGCGAGCTATACTGACTCCTG GGGCCAGGGCACCCTGGTCACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1954 | QVQLVQSGGGLVQPGRSLRLSCTASGF TFGDYAMSWFRQAPGKGLEWVGFIRS KAYGGTTEYAASVKGRFTISRDDSKSI AYLQMNSLKTEDTAVYYCTAKGGYV GYSYGPFGGYWGQGTLVTVSSASTKG PSVFPLAPCSRSTSESTAALGCLVKDYF PEPVTVSWNSGALTSGVHTFPAVLQSS GLYSLSSVVTVPSSSLGTKTYTCNVDH KPSNTKVDKRVESKYGPPCPPCPAPEF LGGPSVFLFPPKPKDTLMISRTPEVTCV VVDVSQEDPEVQFNWYVDGVEVHNA KTKPREEQFNSTYRVVSVLTVLHQDW LNGKEYKCKVSNKGLPSSIEKTISKAK GQPREPQVYTLPPSQEEMTKNQVSLTC LVKGFYPSDIAVEWESNGQPENNYKT TPPVLDSDGSFFLYSRLTVDKSRWQEG NVFSCSVMHEALHNHYTQKSLSLSLG K | SEQ ID 2062 | CAGGTCCAGCTGGTGCAGTCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACCGCT AAGGGGGGCTACGTCGGATACAGCT ATGGACCTTTTGGGGGCTACTGGGG CCAGGGAACCCTGGTCACCGTCTCC TCAGCATCCACCAAGGGGCCTTCCG TGTTCCCCCTGGCCCCTTGCTCCCGC TCGACCTCTGAATCCACCGCCGCAC TCGGTTGCCTGGTCAAAGACTACTT CCCCGAGCCCGTGACTGTCTCGTGG AACTCGGGCGCCCTCACATCCGGAG TGCATACCTTTCCCGCCGTGTTGCA GTCCAGCGGCCTGTACAGCCTGAGC TCCGTCGTGACAGTGCCGTCCTCCT CCCTTGGAACCAAGACCTATACCTG CAACGTCGACCACAAGCCCTCCAAC ACCAAAGTGGACAAGCGCGTCGAA TCCAAGTACGGCCCCCCTTGTCCGC CTTGTCCAGCCCTGAGTTCCTGGG TGGTCCGTCCGTGTTCCTCTTCCCGC CCAAGCCGAAGGACACTCTGATGAT TTCACGCACCCCGGAAGTCACTTGC GTGGTCGTGGACGTGTCGCAGGAAG ATCCCGAAGTGCAGTTCAATTGGTA CGTGGATGGGGTCGAAGTGCACAAC GCCAAGACCAAGCCTAGGGAAGAA CAGTTCAACTCTACGTACCGGGTGG TGTCCGTGCTGACCGTGCTGCACCA GGACTGGCTGAACGGAAAGGAGTA CAAGTGCAAAGTGTCAAACAAGGG CCTCCCTTCATCCATCGAAAAGACC ATCAGCAAGGCCAAGGGTCAACCTA GGGAGCCCCAGGTCTACACTTTGCC GCCTAGCCAAGAAGAAATGACTAA GAACCAAGTGTCCCTGACTTGCCTT GTCAAGGGCTTTTATCCGTCCGACA TCGCCGTGGAGTGGGAGTCCAACGG ACAACCGGAGAACAACTACAAGAC CACCCCACCGGTGCTCGATTCCGAT GGCTCCTTCTTCCTGTACTCCCGGCT GACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1955 | QVQLVQSGGGLVQPGRSLRLSCTASGF TFGDYAMSWFRQAPGKGLEWVGFIRS KAYGGTTEYAASVKGRFTISRDDSKSI AYLQMNSLKTEDTAVYYCTRGGTMV RGFGFNYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2063 | CAGGTGCAGCTGGTGCAGTCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA GGGGGGACTATGGTTCGGGGTTTCG GATTTAACTACTGGGGCCAGGGAAC CCTGGTCACCGTCTCCTCAGCATCC ACCAAGGGCCTTCCGTGTTCCCCC TGGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1956 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARARRAMIGPLP RLVGYFDLWGRGTLVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2064 | CAGGTGCAGCTACAGCAGTGGGGC GCAGGACTGTTGAAGCCTTCGGAGA CCCTGTCCCTCACCTGCGCTGTCTAT GGTGGGTCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGCCCGGCG GGCTATGATAGGGCCGCTTCCGCGA CTTGGCTACTTTGATCTCTGGG GCCGTGGAACCCTGGTCACCGTCTC CTCAGCATCCACCAAGGGGCCTTCC GTGTTCCCCCTGGCCCCTTGCTCCCG CTCGACCTCTGAATCCACCGCCGCA CTCGGTTGCCTGGTCAAAGACTACT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCCCCGAGCCCGTGACTGTCTCGTG GAACTCGGGCGCCCTCACATCCGGA GTGCATACCTTTCCCGCCGTGTTGC AGTCCAGCGGCCTGTACAGCCTGAG CTCCGTCGTGACAGTGCCGTCCTCC TCCCTTGGAACCAAGACCTATACCT GCAACGTCGACCACAAGCCCTCCAA CACCAAAGTGGACAAGCGCGTCGA ATCCAAGTACGGCCCCCCTTGTCCG CCTTGTCCAGCCCCTGAGTTCCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCAGGAA GATCCCGAAGTGCAGTTCAATTGGT ACGTGGATGGGGTCGAAGTGCACA ACGCCAAGACCAAGCCTAGGGAAG AACAGTTCAACTCTACGTACCGGGT GGTGTCCGTGCTGACCGTGCTGCAC CAGGACTGGCTGAACGGAAAGGAG TACAAGTGCAAAGTGTCAAACAAG GGCCTCCCTTCATCCATCGAAAAGA CCATCAGCAAGGCCAAGGGTCAACC TAGGGAGCCCCAGGTCTACACTTTG CCGCCTAGCCAAGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCCGGC TGACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 1957 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGRPAPSWVKT RNWFDPWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2065 | CAGGTGCAGCTACAGCAGTGGGGC GCAGGACTGTTGAAGCCTTCGGAGA CCCTGTCCCTCACCTGCGCTGTCTAT GGTGGGTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGGCCGCCC CGCCCCATCCTGGGTTAAAACCCGT AACTGGTTCGACCCCTGGGGCCAGG GAACCCTGGTCACCGTCTCCTCAGC ATCCACCAAGGGGCCTTCCGTGTTC CCCCTGGCCCCTTGCTCCCGCTCGA CCTCTGAATCCACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1958 | QVQLQQSGPGLVKPSQTLSLTCAISGD SVSSNSAAWNWIRQSPSRGLEWLGRT YYRSKWYNDYAVSVKSRITINPDTSKN QFSLQLNSVTPEDTAVYYCAREASSG WNWGQGTLVTVSSASTKGPSVFPLAP CSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2066 | CAGGTACAGCTGCAGCAGTCAGGTC CAGGACTGGTGAAGCCCTCGCAGAC CCTCTCACTCACCTGTGCCATCTCCG GGGACAGTGTCTCTAGCAACAGTGC TGCTTGGAACTGGATCAGGCAGTCC CCATCGAGAAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGGCTGTGTATTACTGTGCAA GAGAGGCTAGCAGTGGCTGGAACT GGGGCCAGGGAACCCTGGTCACCGT CTCCTCAGCATCCACCAAGGGGCCT TCCGTGTTCCCCCTGGCCCCTTGCTC CCGCTCGACCTCTGAATCCACCGCC GCACTCGGTTGCCTGGTCAAAGACT ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCAAGACCTATA CCTGCAACGTCGACCACAAGCCCTC CAACACCAAAGTGGACAAGCGCGT CGAATCCAAGTACGGCCCCCCCTTGT CCGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1959 | QVQLQESGPGLVKPSQTLSLTCAISGD SVSSNNAAWNWIRQSPSRGLEWLGRT FYRSKWYNDYAVSVKSRLTVNPDTSK NQFSLRLNSVSPEDTAVYYCARGGRY TKGGYFDDWGQGTLVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2067 | CAGGTGCAGCTGCAGGAGTCCGGTC CAGGACTGGTGAAGCCCTCGCAGAC CCTCTCACTCACCTGTGCCATCTCCG GGGACAGTGTCTCTAGCAACAATGC TGCTTGGAACTGGATCAGGCAGTCC CCATCGAGAGGCCTTGAGTGGCTGG GAAGGACATTCTACAGGTCCAAGTG GTATAATGACTATGCAGTTTCTGTG AAAAGTCGACTAACCGTCAACCCAG ACACATCCAAGAACCAGTTCTCCCT GCGGTTGAACTCTGTGAGTCCCGAG GACACGGCTGTGTATTACTGTGCAA GAGGGGGAAGATATACCAAGGGAG GGTACTTTGACGACTGGGGCCAGGG AACCCTGGTGACCGTCTCCTCAGCA TCCACCAAGGGGCCTTCCGTGTTCC CCTGGCCCCTTGCTCCCGCTCGAC CTCTGAATCCACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1960 | QVTLKESGPTLVKPTQTLTLTCTFSGFS LSTSGVGVGWIRQPPGKALEWLALIY WDDDKRYSPSLKSRLTITKDTSKNQV VLTMTNMDPVDTATYYCAHRLDSSGR GGYFDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2068 | CAGGTCACCTTGAAGGAGTCTGGTC CTACGCTGGTGAAACCCACACAGAC CCTCACGCTGACCTGCACCTTCTCTG GGTTCTCACTCAGCACTAGTGGAGT GGGTGTGGGCTGGATCCGTCAGCCC CCAGGAAAGGCCCTGGAGTGGCTTG CACTCATTTATTGGGATGATGATAA GCGCTACAGCCCATCTCTGAAGAGC AGGCTCACCATCACCAAGGACACCT CCAAAAACCAGGTGGTCCTTACAAT GACCAACATGGACCCTGTGGACACA GCCACATATTACTGTGCACACAGAT TGGATAGCAGTGGCCGTGGTGGTTA CTTTGACTACTGGGGCCAGGGCACC CTGGTCACCGTCTCCTCAGCATCCA CCAAGGGGCCTTCCGTGTTCCCCCT GGCCCCTTGCTCCCGCTCGACCTCT GAATCCACCGCCGCACTCGGTTGCC TGGTCAAAGACTACTTCCCCGAGCC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1961 | EVOLVESGGGVVQPGRSLRLSCTASGF TFSSYGMHWVRQAPGKGLEWVAVISY DGSNKYYADSVKGRFTISRDNSKNTL YLQMNSLRAEDTAVYYCAKELVGTSS PYYYYYGMDVWGQGTMVTVSSAST KGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2069 | GAGGTGCAGCTGGTGGAGTCTGGGG GAGGCGTGGTCCAGCCTGGGAGGTC CCTGAGACTCTCCTGTACAGCCTCT GGATTCACCTTCAGTAGCTATGGCA TGCACTGGGTCCGCCAGGCTCCAGG CAAGGGGCTGGAGTGGGTGGCAGTT ATATCATATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAAGAGTT GGTGGGTACCAGCTCTCCTTATTAC TACTACTACTACGGTATGGACGTCT GGGGCCAAGGGACAATGGTCACCG TCTTCTTCAGCATCCACCAAGGGCC TTCCGTGTTCCCCCTGGCCCCTTGCT CCCGCTCGACCTCTGAATCCACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCAAGACCTAT ACCTGCAACGTCGACCACAAGCCCT CCAACACCAAAGTGGACAAGCGCG TCGAATCCAAGTACGGCCCCCCTTG TCCGCCTTGTCCAGCCCCTGAGTTCC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAG GAAGATCCCGAAGTGCAGTTCAATT GGTACGTGGATGGGGTCGAAGTGCA CAACGCCAAGACCAAGCCTAGGGA AGAACAGTTCAACTCTACGTACCGG GTGGTGTCCGTGCTGACCGTGCTGC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACCAGGACTGGCTGAACGGAAAGG AGTACAAGTGCAAAGTGTCAAACA AGGGCCTCCCTTCATCCATCGAAAA GACCATCAGCAAGGCCAAGGGTCA ACCTAGGGAGCCCCAGGTCTACACT TTGCCGCCTAGCCAAGAAGAAATGA CTAAGAACCAAGTGTCCCTGACTTG CCTTGTCAAGGGTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1962 | QLQLQESGGGLVQPGGSLRLSCAASGF TVSSNYMSWVRQAPGKGLEWVSVIYS GGSTYYADSVKGRFTISRDNSKNTLYL QMNSLRAEDTAVYYCARDYYYGSGSS PWGQGTLVTVSSASTKGPSVFPLAPCS RSTSESTAALGCLVKDYFPEPVTVSWN SGALTSGVHTFPAVLQSSGLYSLSSVV TVPSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2070 | CAGCTGCAGCTGCAGGAGTCGGGG GGAGGCTTGGTCCAGCCTGGGGGGT CCCTGAGACTCTCCTGTGCAGCCTC TGGATTCACCGTCAGTAGCAACTAC ATGAGCTGGGTCCGCCAGGCTCCAG GGAAGGGGCTGGAGTGGGTCTCAGT TATTTATAGCGGTGGTAGCACATAC TACGCAGACTCCGTGAAGGGCAGAT TCACCATCTCCAGAGACAATTCCAA GAACACGCTGTATCTTCAAATGAAC AGCCTGAGAGCCGAGGACACGGCT GTGTATTACTGTGCGAGAGACTATT ACTATGGTTCGGGGAGTTCTCCCTG GGGCCAGGGAACCCTGGTCACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1963 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGRPYCSSTSCY PEWFDPWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2071 | CAGGTGCAGCTACAGCAGTGGGGC GCAGGACTGTTGAAGCCTTCGGAGA CCCTGTCCCTCACCTGCGCTGTCTAT GGTGGTTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGGCCGGCC ATATTGTAGTAGTACCAGCTGCTAC CCAGAGTGGTTCGACCCCTGGGGCC AGGGAACCCTGGTCACCGTCTCCTC AGCATCCACCAAGGGGCCTTCCGTG TTCCCCCTGGCCCCTTGCTCCCGCTC GACCTCTGAATCCACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCAAGACCTATACCTGCAA CGTCGACCACAAGCCCTCCAACACC AAAGTGGACAAGCGCGTCGAATCC AAGTACGGCCCCCCTTGTCCGCCTT GTCCAGCCCCTGAGTTCCTGGGTGG TCCGTCCGTGTTCCTCTTCCCGCCCA AGCCGAAGGACACTCTGATGATTTC ACGCACCCCGGAAGTCACTTGCGTG GTCGTGGACGTGTCGCAGGAAGATC CCGAAGTGCAGTTCAATTGGTACGT GGATGGGGTCGAAGTGCACAACGC CAAGACCAAGCCTAGGGAAGAACA GTTCAACTCTACGTACCGGGTGGTG TCCGTGCTGACCGTGCTGCACCAGG ACTGGCTGAACGGAAAGGAGTACA AGTGCAAAGTGTCAAACAAGGGCCT CCCTTCATCCATCGAAAAGACCATC AGCAAGGCCAAGGGTCAACCTAGG GAGCCCCAGGTCTACACTTTGCCGC CTAGCCAAGAAGAAATGACTAAGA ACCAAGTGTCCCTGACTTGCCTTGT CAAGGGCTTTTATCCGTCCGACATC GCCGTGGAGTGGGAGTCCAACGGA CAACCGGAGAACAACTACAAGACC ACCCCACCGGTGCTCGATTCCGATG GCTCCTTCTTCCTGTACTCCCGGCTG ACTGTGGACAAGTCAAGATGGCAG GAGGGAAACGTGTTCTCCTGCTCCG TGATGCACGAAGCGCTGCACAACCA TTACACCCAGAAATCACTGTCACTT TCGCTGGGAAAA |
| SEQ ID 1964 | QVTLKESGGGVVQPGRSLRLSCAASGF TFSSYGMHWVRQAPGKGLEWVAVISY DGSNKYYADSVKGRFTISRDNSKNTL YLQMNSLRAEDTAVYYCAKLRGIDYY DSSGYQRGFDYWGQGTLVTVSSASTK GPSVFPLAPCSRSTSESTAALGCLVKD YFPEPVTVSWNSGALTSGVHTFPAVLQ SSGLYSLSSVVTVPSSSLGTKTYTCNV DHKPSNTKVDKRVESKYGPPCPPCPAP EFLGGPSVFLFPPKPKDTLMISRTPEVT CVVVDVSQEDPEVQFNWYVDGVEVH NAKTKPREEQFNSTYRVVSVLTVLHQ DWLNGKEYKCKVSNKGLPSSIEKTISK AKGQPREPQVYTLPPSQEEMTKNQVS LTCLVKGFYPSDIAVEWESNGQPENNY KTTPPVLDSDGSFFLYSRLTVDKSRWQ EGNVFSCSVMHEALHNHYTQKSLSLS LGK | SEQ ID 2072 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGGCA TGCACTGGGTCCGCCAGGCTCCAGG CAAGGGGCTGGAGTGGGTGGCAGTT ATATCATATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAATTAAG GGGTATAGATTACTATGATAGTAGT GGTTACCAACGGGGGTTTGACTACT GGGGCCAGGGAACCCTGGTCACCGT CTCCTCAGCATCCACCAAGGGGCCT TCCGTGTTCCCCCTGGCCCCTTGCTC CCGCTCGACCTCTGAATCCACCGCC GCACTCGGTTGCCTGGTCAAAGACT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCAAGACCTATA CCTGCAACGTCGACCACAAGCCCTC CAACACCAAAGTGGACAAGCGCGT CGAATCCAAGTACGGCCCCCCCTTGT CCGCCTTGTCCAGCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1965 | QVQLQESGPGLVKPSETLSLTCTVSGG SISSYYWSWIRQPPGKGLEWIGYIYYT GSTNYNPSLKSRVTISVDTSKNQFSLKL SSVTTADTAVYYCARGGRGDGAAFDI WGQGTMVTVSSASTKGPSVFPLAPCS RSTSESTAALGCLVKDYFPEPVTVSWN SGALTSGVHTFPAVLQSSGLYSLSSVV TVPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2073 | CAGGTGCAGCTGCAGGAGTCCGGCC CAGGACTGGTGAAGCCTTCGGAGAC CCTGTCCCTCACCTGCACTGTCTCTG GTGGCTCCATCAGTAGTTACTACTGG GAGCTGGATCCGGCAGCCCCCAGGG AAGGGACTGGAGTGGATTGGCTATA TCTATTACACTGGGAGCACCAACTA CAACCCCTCCCTCAAGAGCCGAGTC ACCATATCAGTAGACACGTCCAAGA ACCAGTTCTCCCTGAAGCTGAGCTC TGTGACCACTGCGGACACGGCCGTG TATTACTGTGCGAGAGGTGGGAGGG GGGATGGGGCCGCTTTTGACATCTG GGGCCAAGGGACAATGGTCACCGTC TCTTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGCCCCCCCTTGTC CGCCTTGTCCAGCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1966 | QVQLVQSGGGVVQPGRSLRLSCAASG FTFSSSAMHWVRQAPGKGLEWVAMI WHDESKKYYADSVKGRFTISRDNSKN TLYLQMNSLRAEDTAVYYCARPPDGG NSGRWYFDLWGRGTLVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | SEQ ID 2074 | CAGGTGCAGCTGGTGCAATCTGGGG GAGGCGTGGTCCAGCCTGGGAGGTC CCTGAGACTCTCCTGTGCAGCGTCT GGATTCACCTTCAGCAGCTCTGCCA TGCACTGGGTCCGCCAGGCTCCAGG CAAGGGACTGGAGTGGGTGGCAAT GATTTGGCATGATGAGAGTAAGAAA TACTATGCAGACTCCGTGAAGGGCC GATTCACTATCTCCAGAGACAATTC CAAGAACACGTGTATCTGCAAATG AACAGCCTGAGAGCTGAGGACACG GCTGTGTATTACTGTGCGAGACCCC CCGACGGTGGTAACTCCGGTCGCTG GTACTTCGATCTCTGGGGCCGTGGC ACCCTGGTCACCGTCTCCTCAGCAT CCACCAAGGGGCCTTCCGTGTTCCC CCTGGCCCCTTGCTCCCGCTCGACCT CTGAATCCACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCAAGACCTATACCTGCAACGTC GACCACAAGCCCTCCAACACCAAAG TGGACAAGCGCGTCGAATCCAAGTA CGGCCCCCCTTGTCCGCCTTGTCCA GCCCCTGAGTTCCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1967 | QMQLVQSGGGLVQPGGSLRLSCAASG FTFSSYAMSWVRQAPGKGLEWVSAIS GSGGSTYYADSVKGRFTISRDNSKNTL YLQMNSLRAEDTAVYYCAKDKNVRK HDYGDHPYGGYFDYWGQGTLVTVSS ASTKGPSVFPLAPCSRSTSESTAALGCL VKDYFPEPVTVSWNSGALTSGVHTFP AVLQSSGLYSLSSVVTVPSSSLGTKTY TCNVDHKPSNTKVDKRVESKYGPPCP PCPAPEFLGGPSVFLFPPKPKDTLMISR TPEVTCVVVDVSQEDPEVQFNWYVDG VEVHNAKTKPREEQFNSTYRVVSVLT VLHQDWLNGKEYKCKVSNKGLPSSIE KTISKAKGQPREPQVYTLPPSQEEMTK NQVSLTCLVKGFYPSDIAVEWESNGQP ENNYKTTPPVLDSDGSFFLYSRLTVDK SRWQEGNVFSCSVMHEALHNHYTQKS LSLSLGK | SEQ ID 2075 | CAGATGCAGCTGGTGCAATCGGGG GAGGCTTGGTACAGCCTGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGACAA GAACGTCCGAAAACATGACTACGGT GACCACCCCTACGGGGGGTACTTTG ACTACTGGGGCCAGGGCACCCTGGT GACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AAGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1968 | EVQLVQSGAEVKKPGASVKVSCKASG YTFTSYAMHWVRQAPGQRLEWMGWI NAGNGNTKYSQKFQGRVTITRDTSAST AYMELSSLRSEDTAVYYCARVAGATS LWYWGQGTLVTVSSASTKGPSVFPLA PCSRSTSESTAALGCLVKDYFPEPVTVS WNSGALTSGVHTFPAVLQSSGLYSLSS GATCAACGCTGGCAATGGTAACACA VVTVPSSSLGTKTYTCNVDHKPSNTKV AAATATTCACAGAAGTTCCAGGGCA DKRVESKYGPPCPPCPAPEFLGGPSVFL GAGTCACCATTACCAGGGACACATC FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV | SEQ ID 2076 | GAGGTCCAGCTGGTACAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG CGCGAGCACAGCCTACATGGAGCTG AGCAGCCTGAGATCTGAAGACACG GCTGTGTATTACTGTGCGAGAGTGG CGGGAGCTACTTCCCTATGGTACTG GGGCCAGGGCACCCTGGTCACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | MHEALHNHYTQKSLSLSLGK | | AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1969 | QVQLQQSGPGLVKPSQSLSLTCAISGD SVSSNSAAWNWIRQSPSRGLEWLGRT YYRSKWYNDYAVSVKSRITIKPDTSKN QFSLQLNSVTPEDTAVYYCTRLANSDG VDVWGQGTMVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2077 | CAGGTACAGCTGCAGCAGTCAGGTC CAGGACTGGTGAAGCCCTCGCAGAG CCTCTCACTCACCTGTGCCATCTCCG GGGACAGTGTCTCTAGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAGAGTCGAATAACCATCAAACCA GACACATCCAAGAACCAGTTCTCCC TGCAGCTGAACTCTGTGACTCCCGA GGACACGGCTGTGTATTACTGTACA AGGCTAGCTAATTCCGACGGTGTGG ACGTCTGGGGCCAAGGGACAATGGT CACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AAGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACTTTGCCGCCTAGCCAAGAAGAAA<br>TGACTAAGAACCAAGTGTCCCTGAC<br>TTGCCTTGTCAAGGGCTTTTATCCGT<br>CCGACATCGCCGTGGAGTGGGAGTC<br>CAACGGACAACCGGAGAACAACTA<br>CAAGACCACCCCACCGGTGCTCGAT<br>TCCGATGGCTCCTTCTTCCTGTACTC<br>CCGGCTGACTGTGGACAAGTCAAGA<br>TGGCAGGAGGGAAACGTGTTCTCCT<br>GCTCCGTGATGCACGAAGCGCTGCA<br>CAACCATTACACCCAGAAATCACTG<br>TCACTTTCGCTGGGAAAA |
| SEQ ID 1970 | QVQLQQSGPGLVKPSQTLSLTCAISGD<br>SVSSDSAVWTWIRQSPSRGLEWLGRT<br>YYKSKWYNDYAASVKSRITINPDTSK<br>NQFSLHLNSVTPEDTAVYYCARGVTR<br>TFDYWGQGTTVTVSSASTKGPSVFPLA<br>PCSRSTSESTAALGCLVKDYFPEPVTVS<br>WNSGALTSGVHTFPAVLQSSGLYSLSS<br>VVTVPSSSLGTKTYTCNVDHKPSNTKV<br>DKRVESKYGPPCPPCPAPEFLGGPSVFL<br>FPPKPKDTLMISRTPEVTCVVVDVSQE<br>DPEVQFNWYVDGVEVHNAKTKPREE<br>QFNSTYRVVSVLTVLHQDWLNGKEYK<br>CKVSNKGLPSSIEKTISKAKGQPREPQV<br>YTLPPSQEEMTKNQVSLTCLVKGFYPS<br>DIAVEWESNGQPENNYKTTPPVLDSD<br>GSFFLYSRLTVDKSRWQEGNVFSCSV<br>MHEALHNHYTQKSLSLSLGK | SEQ ID 2078 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCGACAGTGC<br>TGTTTGGACCTGGATCAGGCAGTCC<br>CCATCGAGAGGCCTTGAGTGGCTGG<br>GAAGGACATACTACAAGTCGAAGT<br>GGTATAATGATTATGCAGCATCTGT<br>GAAAAGTCGAATAACCATCAACCCA<br>GACACATCCAAGAACCAGTTCTCCC<br>TGCACCTGAACTCTGTGACTCCCGA<br>GGACACGGCTGTGTATTACTGTGCA<br>AGAGGTGTAACCCGGACCTTTGACT<br>ACTGGGGCCAGGGGACCACGGTCA<br>CCGTCTCCTCAGCATCCACCAAGGG<br>GCCTTCCGTGTTCCCCCTGGCCCCTT<br>GCTCCCGCTCGACCTCTGAATCCAC<br>CGCCGCACTCGGTTGCCTGGTCAAA<br>GACTACTTCCCCGAGCCCGTGACTG<br>TCTCGTGGAACTCGGGCGCCCTCAC<br>ATCCGGAGTGCATACCTTTCCCGCC<br>GTGTTGCAGTCCAGCGGCCTGTACA<br>GCCTGAGCTCCGTCGTGACAGTGCC<br>GTCCTCCTCCCTTGGAACCAAGACC<br>TATACCTGCAACGTCGACCACAAGC<br>CCTCCAACACCAAAGTGGACAAGCG<br>CGTCGAATCCAAGTACGGCCCCCCT<br>TGTCCGCCTTGTCCAGCCCCTGAGTT<br>CCTGGGTGGTCCGTCCGTGTTCCTCT<br>TCCCGCCCAAGCCGAAGGACACTCT<br>GATGATTTCACGCACCCCGGAAGTC<br>ACTTGCGTGGTCGTGGACGTGTCGC<br>AGGAAGATCCCGAAGTGCAGTTCAA<br>TTGGTACGTGGATGGGGTCGAAGTG<br>CACAACGCCAAGACCAAGCCTAGG<br>GAAGAACAGTTCAACTCTACGTACC<br>GGGTGGTGTCCGTGCTGACCGTGCT<br>GCACCAGGACTGGCTGAACGGAAA<br>GGAGTACAAGTGCAAAGTGTCAAA<br>CAAGGGCCTCCCTTCATCCATCGAA<br>AAGACCATCAGCAAGGCCAAGGGT<br>CAACCTAGGGAGCCCCAGGTCTACA<br>CTTTGCCGCCTAGCCAAGAAGAAAT<br>GACTAAGAACCAAGTGTCCCTGACT<br>TGCCTTGTCAAGGGCTTTTATCCGTC<br>CGACATCGCCGTGGAGTGGGAGTCC<br>AACGGACAACCGGAGAACAACTAC<br>AAGACCACCCCACCGGTGCTCGATT<br>CCGATGGCTCCTTCTTCCTGTACTCC<br>CGGCTGACTGTGGACAAGTCAAGAT<br>GGCAGGAGGGAAACGTGTTCTCCTG<br>CTCCGTGATGCACGAAGCGCTGCAC<br>AACCATTACACCCAGAAATCACTGT<br>CACTTTCGCTGGGAAAA |
| SEQ ID 1971 | QLQLQESGPGLVKPSQTLSLTCAISGDS<br>VSSNSAAWNWIRQSPSRGLEWLGRTY<br>YRSKWYNDYAVSVKSRITINPDTSKNQ<br>FSLQLNSVTPEDTAVYYCAEGNGPFDP<br>WGQGTLVTVSSASTKGPSVFPLAPCSR<br>STSESTAALGCLVKDYFPEPVTVSWNS<br>GALTSGVHTFPAVLQSSGLYSLSSVVT | SEQ ID 2079 | CAGCTGCAGCTGCAGGAGTCGGGTC<br>CAGGACTGGTGAAGCCCTCGCAGAC<br>CCTCTCACTCACCTGTGCCATCTCCG<br>GGGACAGTGTCTCTAGCAACAGTGC<br>TGCTTGGAACTGGATCAGGCAGTCC<br>CCATCGAGAGGCCTTGAGTGGCTGG<br>GAAGGACATACTACAGGTCCAAGTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | VPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | | GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGGCTGTGTATTACTGTGCAG AAGGCAATGGGCCGTTCGACCCCTG GGGCCAGGGAACCCTGGTGACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1972 | QITLKESGGGVVQPGRSLRLSCVASGF TFSTYPMHWVRQAPGKGLEWVAVISY DGRNEYYADSVKGRFTISRDNSKNTL YLQMNSLRAEDTAVYYCATRDTPLVG VSIYWGQGTLVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCWVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2080 | CAGATCACCTTGAAGGAGTCTGGGG GAGGCGTGGTCCAGCCTGGGAGGTC CCTGAGACTCTCCTGTGTAGCCTCT GGATTCACCTTCAGTACCTATCCCA TGCACTGGGTCCGCCAGGCTCCAGG CAAGGGGCTGGAGTGGGTGGCAGTT ATATCATATGATGGACGTAATGAAT ACTACGCAGACTCCGTGAAGGGCCG ATTCACCATCTCCAGAGACAATTCC AAAAACACGCTGTATCTGCAAATGA ACAGTCTGCGAGCTGAAGACACGGC TGTCTATTATTGTGCGACTCGGGAT ACACCTTTGGTTGGGGTTTCGATAT ACTGGGGCCAGGGCACCCTGGTCAC CGTCTCCTCAGCATCCACCAAGGGG CCTTCCGTGTTCCCCTGGCCCCTTG CTCCCGCTCGACCTCTGAATCCACC GCCGCACTCGGTTGCCTGGTCAAAG ACTACTTCCCCGAGCCCGTGACTGT CTCGTGGAACTCGGGCGCCCTCACA TCCGGAGTGCATACCTTTCCCGCCG TGTTGCAGTCCAGCGGCCTGTACAG CCTGAGCTCCGTCGTGACAGTGCCG TCCTCCTCCCTTGGAACCAAGACCT ATACCTGCAACGTCGACCACAAGCC CTCCAACACCAAAGTGGACAAGCGC GTCGAATCCAAGTACGGCCCCCCTT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 1973 | QMQLVQSGGGLVKAGGSLRLSCSASG FTFSSYAMHWVRQAPGKGLEYVSAISS NGGSTYYADSVKGRFTISRDNSKNTLY LQMSSLRAEDTAVYYCVNRAGYGDY RHFQHWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2081 | CAGATGCAGCTGGTGCAATCTGGGG GAGGCCTGGTCAAGGCTGGGGGGTC CCTGAGACTCTCCTGTTCAGCCTCTG GATTCACCTTCAGTAGCTATGCTAT GCACTGGGTCCGCCAGGCTCCAGGG AAGGGACTGGAATATGTTTCAGCTA TTAGTAGTAATGGGGGTAGCACATA CTACGCAGACTCAGTGAAGGGCAG ATTCACCATCTCCAGAGACAATTCC AAGAACACGCTGTATCTTCAAATGA GCAGTCTGAGAGCTGAGGACACGG CTGTGTATTACTGTGTGAATCGGGC GGGTTACGGTGACTACAGACACTTC CAGCACTGGGGCCAGGGCACCCTGG TCACCGTCTCCTCAGCATCCACCAA GGGGCCTTCCGTGTTCCCCCTGGCC CCTTGCTCCCGCTCGACCTCTGAATC CACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1974 | EVQLVQSGGGVVQPGGSLRLSCAASG FTFSSYGMHWVRQAPGKGLEWVAFIS YDGSNKYYADSVKGRFTISRDNSKNT LYLQMNSLRAEDTAVYYCATTGDRFQ EFDYWGQGTLVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2082 | GAGGTGCAGCTGGTGCAGTCTGGGG GAGGCGTGGTCCAGCCTGGGGGGTC CCTGAGACTCTCCTGTGCAGCGTCT GGATTCACCTTCAGTAGCTATGGCA TGCACTGGGTCCGCCAGGCTCCAGG CAAGGGGCTGGAGTGGGTGGCATTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCCGAGGACACGG CCGTATATTACTGTGCGACAACAGG GGACCGCTTCCAAGAGTTTGACTAC TGGGGCCAGGGAACCCTGGTCACCG TCTCCTCAGCATCCACCAAGGGGCC TTCCGTGTTCCCCCTGGCCCCTTGCT CCCGCTCGACCTCTGAATCCACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCAAGACCTAT ACCTGCAACGTCGACCACAAGCCCT CCAACACCAAAGTGGACAAGCGCG TCGAATCCAAGTACGGCCCCCCTTG TCCGCCTTGTCCAGCCCCTGAGTTCC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAG GAAGATCCCGAAGTGCAGTTCAATT GGTACGTGGATGGGGTCGAAGTGCA CAACGCCAAGACCAAGCCTAGGGA AGAACAGTTCAACTCTACGTACCGG GTGGTGTCCGTGCTGACCGTGCTGC ACCAGGACTGGCTGAACGGAAAGG AGTACAAGTGCAAAGTGTCAAACA AGGGCCTCCCTTCATCCATCGAAAA GACCATCAGCAAGGCCAAGGGTCA ACCTAGGGAGCCCCAGGTCTACACT TTGCCGCCTAGCCAAGAAGAAATGA CTAAGAACCAAGTGTCCCTGACTTG CCTTGTCAAGGGCTTTTATCCGTCCG ACATCGCCGTGGAGTGGGAGTCCAA CGGACAACGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1975 | QMQLVQSGGVLLQPGRSLRLSCTASG FTFAAYNINWFRQGPGGGLEWVGFIR ANADSGTTEYAASVKGRFFISRDDSRS TAYLQMTSLKTEDTAVYYCARDDRGR GDDFDYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG | SEQ ID 2083 | CAGATGCAGCTGGTGCAGTCTGGGG GAGTCTTGCTTCAGCCAGGGCGGTC CCTGAGACTCTCCTGTACAGCTTCT GGATTCACCTTTGCTGCTTATAATAT CAACTGGTTCCGCCAGGGTCCTGGG GGGGGGCTGGAGTGGGTAGGTTTCA TTAGAGCCAACGCTGATAGTGGGAC AACAGAGTACGCCGCGTCTGTGAAA GGCAGATTCTTCATCTCAAGAGATG ATTCCAGAAGCACCGCCTACCTGCA AATGACTAGCCTTAAAACCGAGGAC ACAGCCGTTTATTACTGTGCCAGAG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | | ATGATCGGGGTCGGGGAGATGACTT TGACTACTGGGGCCAGGGCACCCTG GTCACCGTCTCCTCAGCATCCACCA AGGGGCCTTCCGTGTTCCCCCTGGC CCCTTGCTCCCGCTCGACCTCTGAAT CCACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCAA GACCTATACCTGCAACGTCGACCAC AAGCCCTCCAACACCAAAGTGGACA AGCGCGTCGAATCCAAGTACGGCCC CCCTTGTCCGCCTTGTCCAGCCCCTG AGTTCCTGGGTGGTCCGTCCGTGTT CCTCTTCCCGCCCAAGCCGAAGGAC ACTCTGATGATTTCACGCACCCCGG AAGTCACTTGCGTGGTCGTGGACGT GTCGCAGGAAGATCCCGAAGTGCA GTTCAATTGGTACGTGGATGGGGTC GAAGTGCACAACGCCAAGACCAAG CCTAGGGAAGAACAGTTCAACTCG CGTACCGGGTGGTGTCCGTGCTGAC CGTGCTGCACCAGGACTGGCTGAAC GGAAAGGAGTACAAGTGCAAAGTG TCAAACAAGGGCCTCCCCTTCATCCA TCGAAAAGACCATCAGCAAGGCCA AGGGTCAACCTAGGGAGCCCCAGGT CTACACTTTGCCGCCTAGCCAAGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCCGGCTGACTGTGGACAAGTC AAGATGGCAGGAGGGAAACGTGTT CTCCTGCTCCGTGATGCACGAAGCG CTGCACAACCATTACACCCAGAAAT CACTGTCACTTTCGCTGGGAAAA |
| SEQ ID 1976 | QVQLVQSGGGLVQPGGSLRLSCAASG FTFSSYGMTWVRQAPGKGLEWVSTIS GNGVGTYYPDSVKDRFTISRDSSKNTV YLQMNSLRAEDTAVYYCVKHGRAGIN WYFDLWGRGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2084 | CAGGTGCAGCTGGTGCAATCTGGGG GAGGCTTGGTACAGCCTGGGGGGTC CCTGAGACTCTCCTGTGCAGCCTCT GGATTCACCTTTAGCAGCTATGGCA TGACGTGGGTCCGCCAGGCTCCAGG GAAGGGGCTGGAGTGGGTCTCAACT ATTAGTGGTAATGGTGTTGGCACAT ACTACCCAGACTCCGTGAAGGACCG GTTCACCATCTCCAGAGACAGTTCC AAGAACACGGTGTATCTGCAAATGA ACAGCCTGAGAGCCGAGGACACGG CCGTATATTACTGTGTGAAACATGG TAGGGCCGGAATAAACTGGTACTTC GATCTCTGGGGCCGTGGCACCCTGG TGACCGTCTCCTCAGCATCCACCAA GGGGCCTTCCGTGTTCCCCCTGGCC CCTTGCTCCCGCTCGACCTCTGAATC CACCGCCGCACTCGGTTGCCTGGTC AAAGACTACTTCCCCGAGCCCGTGA CTGTCTCGTGGAACTCGGGCGCCCT CACATCCGGAGTGCATACCTTTCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CGCAGGAAGATCCCGAAGTGCAGTT<br>CAATTGGTACGTGGATGGGGTCGAA<br>GTGCACAACGCCAAGACCAAGCCTA<br>GGGAAGAACAGTTCAACTCTACGTA<br>CCGGGTGGTGTCCGTGCTGACCGTG<br>CTGCACCAGGACTGGCTGAACGGAA<br>AGGAGTACAAGTGCAAAGTGTCAA<br>ACAAGGGCCTCCCTTCATCCATCGA<br>AAAGACCATCAGCAAGGCCAAGGG<br>TCAACCTAGGGAGCCCCAGGTCTAC<br>ACTTTGCCGCCTAGCCAAGAAGAAA<br>TGACTAAGAACCAAGTGTCCCTGAC<br>TTGCCTTGTCAAGGGCTTTTATCCGT<br>CCGACATCGCCGTGGAGTGGGAGTC<br>CAACGGACAACCGGAGAACAACTA<br>CAAGACCACCCCACCGGTGCTCGAT<br>TCCGATGGCTCCTTCTTCCTGTACTC<br>CCGGCTGACTGTGGACAAGTCAAGA<br>TGGCAGGAGGGAAACGTGTTCTCCT<br>GCTCCGTGATGCACGAAGCGCTGCA<br>CAACCATTACACCCAGAAATCACTG<br>TCACTTTCGCTGGGAAAA |
| SEQ ID<br>1977 | QVQLQQSGPGLVKPSQTLSLTCAISGD<br>SVSSNSAAWNWIRQSPSRGLEWLGRT<br>YYRSKWYNDYAVSVKSRITINPDTSKN<br>QFSLQLNSVTPEDTAVYYCARGGGLW<br>AFDIWGQGTTVTVSSASTKGPSVFPLA<br>PCSRSTSESTAALGCLVKDYFPEPVTVS<br>WNSGALTSGVHTFPAVLQSSGLYSLSS<br>VVTVPSSSLGTKTYTCNVDHKPSNTKV<br>DKRVESKYGPPCPPCPAPEFLGGPSVFL<br>FPPKPKDTLMISRTPEVTCVVVDVSQE<br>DPEVQFNWYVDGVEVHNAKTKPREE<br>QFNSTYRVVSVLTVLHQDWLNGKEYK<br>CKVSNKGLPSSIEKTISKAKGQPREPQV<br>YTLPPSQEEMTKNQVSLTCLVKGFYPS<br>DIAVEWESNGQPENNYKTTPPVLDSD<br>GSFFLYSRLTVDKSRWQEGNVFSCSV<br>MHEALHNHYTQKSLSLSLGK | SEQ ID<br>2085 | CAGGTACAGCTGCAGCAGTCAGGTC<br>CAGGACTGGTGAAGCCCTCGCAGAC<br>CCTCTCACTCACCTGTGCCATCTCCG<br>GGGACAGTGTCTCTAGCAACAGTGC<br>TGCTTGGAACTGGATCAGGCAGTCC<br>CCATCGAGAGGCCTTGAGTGGCTGG<br>GAAGGACATACTACAGGTCCAAGTG<br>GTATAATGATTATGCAGTATCTGTG<br>AAAAGTCGAATAACCATCAACCCAG<br>ACACATCCAAGAACCAGTTCTCCCT<br>GCAGCTGAACTCTGTGACTCCCGAG<br>GACACGGCTGTGTATTACTGTGCAA<br>GAGGGGGAGGGCTTTGGGCTTTTGA<br>TATCTGGGGCCAAGGGACCACGGTC<br>ACCGTCTCCTCAGCATCCACCAAGG<br>GGCCTTCCGTGTTCCCCCTGGCCCCT<br>TGCTCCCGCTCGACCTCTGAATCCA<br>CCGCCGCACTCGGTTGCCTGGTCAA<br>AGACTACTTCCCCGAGCCCGTGACT<br>GTCTCGTGGAACTCGGGCGCCCTCA<br>CATCCGGAGTGCATACCTTTCCCGC<br>CGTGTTGCAGTCCAGCGGCCTGTAC<br>AGCCTGAGCTCCGTCGTGACAGTGC<br>CGTCCTCCTCCCTTGGAACCAAGAC<br>CTATACCTGCAACGTCGACCACAAG<br>CCCTCCAACACCAAAGTGGACAAGC<br>GCGTCGAATCCAAGTACGGCCCCCC<br>TTGTCCGCCTTGTCCAGCCCTGAGT<br>TCCTGGGTGGTCCGTCCGTGTTCCTC<br>TTCCCGCCCAAGCCGAAGGACACTC<br>TGATGATTTCACGCACCCCGGAAGT<br>CACTTGCGTGGTCGTGGACGTGTCG<br>CAGGAAGATCCCGAAGTGCAGTTCA<br>ATTGGTACGTGGATGGGGTCGAAGT<br>GCACAACGCCAAGACCAAGCCTAG<br>GGAAGAACAGTTCAACTCTACGTAC<br>CGGGTGGTGTCCGTGCTGACCGTGC<br>TGCACCAGGACTGGCTGAACGGAA<br>AGGAGTACAAGTGCAAAGTGTCAA<br>ACAAGGGCCTCCCTTCATCCATCGA<br>AAAGACCATCAGCAAGGCCAAGGG<br>TCAACCTAGGGAGCCCCAGGTCTAC<br>ACTTTGCCGCCTAGCCAAGAAGAAA<br>TGACTAAGAACCAAGTGTCCCTGAC<br>TTGCCTTGTCAAGGGCTTTTATCCGT<br>CCGACATCGCCGTGGAGTGGGAGTC<br>CAACGGACAACCGGAGAACAACTA<br>CAAGACCACCCCACCGGTGCTCGAT<br>TCCGATGGCTCCTTCTTCCTGTACTC<br>CCGGCTGACTGTGGACAAGTCAAGA<br>TGGCAGGAGGGAAACGTGTTCTCCT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GCTCCGTGATGCACGAAGCGCTGCA CAACCATTACACCCAGAAATCACTG TCACTTTCGCTGGGAAAA |
| SEQ ID 1978 | EVQLVQSGAEVKKPGASVKVSCKASG YTFTGYYMHWVRQAPGQGLEWMGW INPNSGGTNYAQKFQGRVTMTRDTSIS TAYMELSRLRSDDTAVYYCARDKIGS CPYWGQGTLVTVSSASTKGPSVFPLAP CSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2086 | GAGGTCCAGCTGGTGCAGTCTGGGG CTGAGGTGAAGAAGCCTGGGGCCTC AGTGAAGGTCTCCTGCAAGGCTTCT GGATACACCTTCACCGGCTACTATA TGCACTGGGTGCGACAGGCCCCTGG ACAAGGGCTTGAGTGGATGGGATG GATCAACCCTAACAGTGGTGGCACA AACTATGCACAGAAGTTTCAGGGCA GGGTCACCATGACCAGGGACACGTC CATCAGCACAGCCTACATGGAGCTG AGCAGGCTGAGATCTGACGACACG GCCGTGTATTACTGTGCGAGAGACA AGATCGGCAGCTGTCCTTACTGGGG CCAGGGAACCCTGGTCACCGTCTCC TCAGCATCCACCAAGGGGCCTTCCG TGTTCCCCCTGGCCCCTTGCTCCCGC TCGACCTCTGAATCCACCGCCGCAC TCGGTTGCCTGGTCAAAGACTACTT CCCCGAGCCCGTGACTGTCTCGTGG AACTCGGGCGCCCTCACATCCGGAG TGCATACCTTTCCCGCCGTGTTGCA GTCCAGCGGCCTGTACAGCCTGAGC TCCGTCGTGACAGTGCCGTCCTCCT CCCTTGGAACCAAGACCTATACCTG CAACGTCGACCACAAGCCCTCCAAC ACCAAAGTGGACAAGCGCGTCGAA TCCAAGTACGGCCCCCCTTGTCCGC CTTGTCCAGCCCTGAGTTCCTGGG TGGTCCGTCCGTGTTCCTCTTCCCGC CCAAGCCGAAGGACACTCTGATGAT TTCACGCACCCCGGAAGTCACTTGC GTGGTCGTGGACGTGTCGCAGGAAG ATCCCGAAGTGCAGTTCAATTGGTA CGTGGATGGGGTCGAAGTGCACAAC GCCAAGACCAAGCCTAGGGAAGAA CAGTTCAACTCTACGTACCGGGTGG TGTCCGTGCTGACCGTGCTGCACCA GGACTGGCTGAACGGAAAGGAGTA CAAGTGCAAGTGTCAAACAAGGG CCTCCCTTCATCCATCGAAAAGACC ATCAGCAAGGCCAAGGGTCAACCTA GGGAGCCCCAGGTCTACACTTTGCC GCCTAGCCAAGAAGAAATGACTAA GAACCAAGTGTCCCTGACTTGCCTT GTCAAGGGCTTTTATCCGTCCGACA TCGCCGTGGAGTGGGAGTCCAACGG ACAACCGGAGAACAACTACAAGAC CACCCCACCGGTGCTCGATTCCGAT GGCTCCTTCTTCCTGTACTCCCGGCT GACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 1979 | QVTLKESGPTLVKPTQTLTLTCTFSGFS LSTSGVGVGWIRQPPGKALEWLALIY WDDDKRYSPSLKSRLTITKDTSKNQV VLTMTNMDPVDTATYYCAHRPDSSQ CFDYWGQGTLVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD | SEQ ID 2087 | CAGGTCACCTTGAAGGAGTCTGGTC CTACGCTGGTGAAACCCACACAGAC CCTCACGCTGACCTGCACCTTCTCTG GGTTCTCACTCAGCACTAGTGGAGT GGGTGTGGGCTGGATCCGTCAGCCC CCAGGAAAGGCCCTGGAGTGGCTTG CACTCATTTATTGGGATGATGATAA GCGCTACAGCCCATCTCTGAAGAGC AGGCTGACCATCACCAAGGACACCT CCAAAAACCAGGTGGTCCTTACAAT GACCAACATGGACCCTGTGGACACA GCCACATATTACTGTGCACACAGAC CGGATAGCAGCAGTCAATGTTTTGA CTACTGGGGCCAGGGAACCCTGGTC ACCGTCTCCTCAGCATCCACCAAGG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | GSFFLYSRLTVDKSRWQEGNVFSCSV MHEALHNHYTQKSLSLSLGK | | GGCCTTCCGTGTTCCCCCTGGCCCCT TGCTCCCGCTCGACCTCTGAATCCA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCAAGAC CTATACCTGCAACGTCGACCACAAG CCCTCCAACACCAAAGTGGACAAGC GCGTCGAATCCAAGTACGGCCCCCC TTGTCCGCCTTGTCCAGCCCCTGAGT TCCTGGGTGGTCCGTCCGTGTTCCTC TTCCCGCCCAAGCCGAAGGACACTC TGATGATTTCACGCACCCCGGAAGT CACTTGCGTGGTCGTGGACGTGTCG CAGGAAGATCCCGAAGTGCAGTTCA ATTGGTACGTGGATGGGGTCGAAGT GCACAACGCCAAGACCAAGCCTAG GGAAGAACAGTTCAACTCTACGTAC CGGGTGGTGTCCGTGCTGACCGTGC TGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1980 | QVTLKESGGGVVQPGRSLRLSCAASGF TFSSYAMHWVRQAPGKGLEWVAVISY DGSNKYYADSVKGRFTISRDNSKNTL YLQMNSLRAEDTAVYYCARSSGWSLP EDYWGQGTLVTVSSASTKGPSVFPLAP CSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2088 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGAAGCAG TGGCTGGTCACTGCCTGAAGACTAC TGGGGCCAGGGAACCCTGGTCACCG TCTCCTCAGCATCCACCAAGGGGCC TTCCGTGTTCCCCCTGGCCCCTTGCT CCCGCTCGACCTCTGAATCCACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCAAGACCTAT ACCTGCAACGTCGACCACAAGCCCT CCAACACCAAAGTGGACAAGCGCG TCGAATCCAAGTACGGCCCCCCTTG TCCGCCTTGTCCAGCCCCTGAGTTCC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAG GAAGATCCCGAAGTGCAGTTCAATT GGTACGTGGATGGGGTCGAAGTGCA CAACGCCAAGACCAAGCCTAGGGA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | AGAACAGTTCAACTCTACGTACCGG GTGGTGTCCGTGCTGACCGTGCTGC ACCAGGACTGGCTGAACGGAAAGG AGTACAAGTGCAAAGTGTCAAACA AGGGCCTCCCTTCATCCATCGAAAA GACCATCAGCAAGGCCAAGGGTCA ACCTAGGGAGCCCCAGGTCTACACT TTGCCGCCTAGCCAAGAAGAAATGA CTAAGAACCAAGTGTCCCTGACTTG CCTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1981 | QVQLVQSGAEVKKPGASVKVSCKVSG YTLTELSMHWVRQAPGKGLEWMGGF DPEDGETIYAQKFQGRVTMTEDTSTDT AYMELSSLRSEDTAVYYCATDVNPEL LGAGFDYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2089 | CAGGTCCAGCTGGTACAGTCTGGGG CTGAGGTGAAGAAGCCTGGGGCCTC AGTGAAGGTCTCCTGCAAGGTTTCC GGATACACCCTCACTGAATTATCCA TGCACTGGGTGCGACAGGCTCCTGG AAAAAGGGCTTGAGTGGATGGGAGG TTTTGATCCTGAAGATGGTGAAACA ATCTACGCACAGAAGTTCCAGGGCA GAGTCACCATGACCGAGGACACATC TACAGACACAGCCTACATGGAGCTG AGCAGCCTGAGATCTGAGGACACG GCCGTGTATTACTGTGCAACGGATG TGAACCCGGAGCTACTGGGGGCGG GATTTGACTACTGGGGCCAGGGCAC CCTGGTCACCGTCTCCTCAGCATCC ACCAAGGGGCCTTCCGTGTTCCCCC TGGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
| --- | --- | --- | --- |
| SEQ ID 1982 | QVTLKESGGGLVQPGGSLRLSCAASGF TFSDQYMDWVRQAPGKGLEWVGRVR NKANSYTTEYAASVKGRFTISRDDSKN SLYLQMNSLNTEDTAMYFCASSLNSG GYRCFHHWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2090 | CAGGTCACCTTGAAGGAGTCTGGGG GAGGCTTGGTCCAGCCTGGAGGGTC CCTGAGACTCTCCTGTGCAGCCTCT GGATTCACCTTCAGTGACCAGTACA TGGACTGGGTCCGCCAGGCTCCAGG GAAGGGGCTGGAGTGGGTTGGCCGT GTTAGAAACAAAGCTAACAGTTACA CCACAGAATACGCCGCGTCTGTGAA AGGCAGATTCACCATCTCAAGAGAT GATTCAAAGAACTCACTGTATCTGC AAATGAATAGTCTGAACACCGAGG ACACGGCCATGTATTTCTGTGCTAG TAGTCTCAATAGTGGGGGCTACCGA TGCTTCCATCACTGGGGCCAGGGCA CCCTGGTGACCGTCTCCTCAGCATC CACCAAGGGGCCTTCCGTGTTCCCC CTGGCCCCTTGCTCCCGCTCGACCTC TGAATCCACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCAAGACCTATACCTGCAACGTCG ACCACAAGCCCTCCAACACCAAAGT GGACAAGCGCGTCGAATCCAAGTAC GGCCCCCCTTGTCCGCCTTGTCCAG CCCCTGAGTTCCTGGGTGGTCCGTC CGTGTTCCTCTTCCCGCCCAAGCCG AAGGACACTCTGATGATTTCACGCA CCCCGGAAGTCACTTGCGTGGTCGT GGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1983 | QVQLVQSGGGLVQPGGSLRLSCSASGF TFSSYAMHWVRQAPGKGLEYVSAISS NGGSTYYADSVKGRFTISRDNSKNTLY LQMSSLRAEDTAVYYCVKAPRGVVPA AMRGGYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2091 | CAGGTCCAGCTGGTGCAGTCTGGGG GAGGCTTGGTCCAGCCTGGGGGGTC CCTGAGACTCTCCTGTTCAGCCTCTG GATTCACCTTCAGTAGCTATGCTAT GCACTGGGTCCGCCAGGCTCCAGG AAGGGACTGGAATATGTTTCAGCTA TTAGTAGTAATGGGGGTAGCACATA CTACGCAGACTCAGTGAAGGGCAG ATTCACCATCTCCAGAGACAATTCC AAGAACACGCTGTATCTTCAAATGA GCAGTCTGAGAGCTGAGGACACGG CTGTGTATTACTGTGTGAAAGCGCC GAGGGGTGTAGTACCAGCTGCTATG CGGGGTGGGTACTGGGGCCAGGGA ACCCTGGTCACCGTCTCCTCAGCAT CCACCAAGGGGCCTTCCGTGTTCCC CCTGGCCCCTTGCTCCCGCTCGACCT CTGAATCCACCGCCGCACTCGGTTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCAAGACCTATACCTGCAACGTC GACCACAAGCCCTCCAACACCAAAG TGGACAAGCGCGTCGAATCCAAGTA CGGCCCCCCTTGTCCGCCTTGTCCA GCCCCTGAGTTCCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1984 | QVQLQESGGGLVQPGRSLRLSCTASGF TFGDYAMSWFRQAPGKGLEWVGFIRS KAYGGTTEYAASVKGRFTISRDDSKSI AYLQMNSLKTEDTAVYYCTRLVGNSG SYYPFGYWGQGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2092 | CAGGTGCAGCTGCAGGAGTCGGGG GGAGGCTTGGTACAGCCAGGGCGGT CCCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA TTGGTGGGCAATAGTGGGAGCTACT ATCCGTTTGGGTACTGGGGCCAGGG AACCCTGGTGACCGTCTCCTCAGCA TCCACCAAGGGGCCTTCCGTGTTCC CCCTGGCCCCTTGCTCCCGCTCGAC CTCTGAATCCACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 1985 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGRSLPYRGLA PRSFGGYYFDYWGQGTLVTVSSASTK GPSVFPLAPCSRSTSESTAALGCLVKD YFPEPVTVSWNSGALTSGVHTFPAVLQ SSGLYSLSSVVTVPSSSLGTKTYTCNV DHKPSNTKVDKRVESKYGPPCPPCPAP EFLGGPSVFLFPPKPKDTLMISRTPEVT CVVVDVSQEDPEVQFNWYVDGVEVH NAKTKPREEQFNSTYRVVSVLTVLHQ DWLNGKEYKCKVSNKGLPSSIEKTISK AKGQPREPQVYTLPPSQEEMTKNQVS LTCLVKGFYPSDIAVEWESNGQPENNY KTTPPVLDSDGSFFLYSRLTVDKSRWQ EGNVFSCSVMHEALHNHYTQKSLSLS LGK | SEQ ID 2093 | CAGGTGCAGCTACAGCAGTGGGGC GCAGGACTGTTGAAGCCTTCGGAGA CCCTGTCCCTCACCTGCGCTGTCTAT GGTGGGTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCGGTGACCGCCGCGGACACGGCTG TGTATTACTGTGCGAGAGGCCGGTC CCTTCCCTACCGGGGGTTGGCTCCT AGATCTTTCGGAGGATACTACTTTG ACTACTGGGGCCAGGGAACCCTGGT CACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1986 | QVQLQESGGGLVRPGGSLRLSCGDSGF NFSGYEMNWVRQAPGKGLEWVSYVS TSGSTRYYADSVKGRFTISRDNAKNTL YLQMNSLRVEDTAVYYCARGRTHWG PQDFDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2094 | CAGGTGCAGCTGCAGGAGTCGGGG GGAGGCTTGGTACGGCCTGGAGGGT CCCTGAGACTCTCCTGTGGAGACTC TGGATTCAACTTCAGTGGATATGAA ATGAACTGGGTCCGCCAGGCTCCAG GGAAGGGGCTGGAGTGGGTTTCATA CGTCAGTACTAGTGGTAGTACCAGA TACTACGCAGACTCTGTGAAGGGCC GATTTACCATCTCCAGAGACAACGC CAAGAACACCCTGTATTTGCAAATG AACAGTCTGAGAGTCGAGGACACG GCTGTGTATTACTGTGCAAGAGGAC GGACTCACTGGGGCCCCCAGGACTT TGACTACTGGGGCCAGGGAACCCTG GTCACCGTCTCCTCAGCATCCACCA AGGGGCCTTCCGTGTTCCCCCTGGC CCCTTGCTCCCGCTCGACCTCTGAAT CCACCGCCGCACTCGGTTGCCTGGT CAAAGACTACTTCCCCGAGCCCGTG ACTGTCTCGTGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCAA GACCTATACCTGCAACGTCGACCAC AAGCCCTCCAACACCAAAGTGGACA AGCGCGTCGAATCCAAGTACGGCCC CCCTTGTCCGCCTTGTCCAGCCCCTG AGTTCCTGGGTGGTCCGTCCGTGTT CCTCTTCCCGCCCAAGCCGAAGGAC ACTCTGATGATTTCACGCACCCCGG AAGTCACTTGCGTGGTCGTGGACGT GTCGCAGGAAGATCCCGAAGTGCA GTTCAATTGGTACGTGGATGGGGTC GAAGTGCACAACGCCAAGACCAAG CCTAGGGAAGAACAGTTCAACTCTA CGTACCGGGTGGTGTCCGTGCTGAC CGTGCTGCACCAGGACTGGCTGAAC GGAAAGGAGTACAAGTGCAAAGTG TCAAACAAGGGCCTCCCTTCATCCA TCGAAAAGACCATCAGCAAGGCCA AGGGTCAACCTAGGGAGCCCCAGGT CTACACTTTGCCGCCTAGCCAAGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCCGGCTGACTGTGGACAAGTC AAGATGGCAGGAGGGAAACGTGTT CTCCTGCTCCGTGATGCACGAAGCG CTGCACAACCATTACACCCAGAAAT CACTGTCACTTTCGCTGGGAAAA |
| SEQ ID 1987 | QVQLQESGGGLVQPGGSLRLSCAASG FTFSSYAMSWVRQAPGKGLEWVSAIS GSGGSTYYADSVKGRFTISRDNSKNTL YLQMNSLRAEDTAVYYCAKGGMYYY GSGSSYFDYWGQGTLVTVSSASTKGPS VFPLAPCSRSTSESTAALGCLVKDYFPE PVTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2095 | CAGGTGCAGCTGCAGGAGTCGGGG GGAGGCTTGGTACGGCCTGGGGGGT CCCTGAGACTCTCCTGTGCAGCCTC TGGATTCACCTTTAGCAGCTATGCC ATGAGCTGGGTCCGCCAGGCTCCAG GGAAGGGGCTGGAGTGGGTCTCAG CTATTAGTGGTAGTGGTGGTAGCAC ATACTACGCAGACTCCGTGAAGGGC CGGTTCACCATCTCCAGAGACAATT CCAAGAACACGCTGTATCTGCAAAT GAACAGCCTGAGAGCCGAGGACAC GGCCGTATATTACTGTGCGAAAGGA GGAATGTATTACTATGGTTCGGGGA GCTCGTACTTTGACTACTGGGGCCA GGGAACCCTGGTGACCGTCTCCTCA GCATCCACCAAGGGGCCTTCCGTGT TCCCCCTGGCCCCTTGCTCCCGCTCG ACCTCTGAATCCACCGCCGCACTCG GTTGCCTGGTCAAAGACTACTTCCC CGAGCCCGTGACTGTCTCGTGGAAC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCGGGCGCCCTCACATCCGGAGTGC<br>ATACCTTTCCCGCCGTGTTGCAGTCC<br>AGCGGCCTGTACAGCCTGAGCTCCG<br>TCGTGACAGTGCCGTCCTCCTCCCTT<br>GGAACCAAGACCTATACCTGCAACG<br>TCGACCACAAGCCCTCCAACACCAA<br>AGTGGACAAGCGCGTCGAATCCAA<br>GTACGGCCCCCCTTGTCCGCCTTGTC<br>CAGCCCCTGAGTTCCTGGGTGGTCC<br>GTCCGTGTTCCTCTTCCCGCCCAAGC<br>CGAAGGACACTCTGATGATTTCACG<br>CACCCCGGAAGTCACTTGCGTGGTC<br>GTGGACGTGTCGCAGGAAGATCCCG<br>AAGTGCAGTTCAATTGGTACGTGGA<br>TGGGGTCGAAGTGCACAACGCCAA<br>GACCAAGCCTAGGGAAGAACAGTT<br>CAACTCTACGTACCGGGTGGTGTCC<br>GTGCTGACCGTGCTGCACCAGGACT<br>GGCTGAACGGAAAGGAGTACAAGT<br>GCAAAGTGTCAAACAAGGGCCTCCC<br>TTCATCCATCGAAAAGACCATCAGC<br>AAGGCCAAGGGTCAACCTAGGGAG<br>CCCCAGGTCTACACTTTGCCGCCTA<br>GCCAAGAAGAAATGACTAAGAACC<br>AAGTGTCCCTGACTTGCCTTGTCAA<br>GGGCTTTTATCCGTCCGACATCGCC<br>GTGGAGTGGGAGTCCAACGGACAA<br>CCGGAGAACAACTACAAGACCACC<br>CCACCGGTGCTCGATTCCGATGGCT<br>CCTTCTTCCTGTACTCCCGGCTGACT<br>GTGGACAAGTCAAGATGGCAGGAG<br>GGAAACGTGTTCTCCTGCTCCGTGA<br>TGCACGAAGCGCTGCACAACCATTA<br>CACCCAGAAATCACTGTCACTTTCG<br>CTGGGAAAA |
| SEQ ID 1988 | QVQLVQSGGGLVQPGGSLRLSCAASG<br>FTFSSYAMSWVRQAPGKGLEWVSGIS<br>GSGGSTYYADSVKGRFTISRDNSKNM<br>LFLQMNSPRAEDTAVYYCAKKIAAAG<br>KQPVDYWGQGTLVTVSSASTKGPSVF<br>PLAPCSRSTSESTAALGCLVKDYFPEPV<br>TVSWNSGALTSGVHTFPAVLQSSGLYS<br>LSSVVTVPSSSLGTKTYTCNVDHKPSN<br>TKVDKRVESKYGPPCPPCPAPEFLGGP<br>SVFLFPPKPKDTLMISRTPEVTCVVVD<br>VSQEDPEVQFNWYVDGVEVHNAKTK<br>PREEQFNSTYRVVSVLTVLHQDWLNG<br>KEYKCKVSNKGLPSSIEKTISKAKGQP<br>REPQVYTLPPSQEEMTKNQVSLTCLVK<br>GFYPSDIAVEWESNGQPENNYKTTPPV<br>LDSDGSFFLYSRLTVDKSRWQEGNVFS<br>CSVMHEALHNHYTQKSLSLSLGK | SEQ ID 2096 | CAGGTGCAGCTGGTGCAATCTGGGG<br>GAGGCTTGGTACAGCCTGGGGGGTC<br>CCTGAGACTCTCCTGTGCAGCCTCT<br>GGATTCACCTTTAGCAGCTATGCCA<br>TGAGCTGGGTCCGCCAGGCTCCAGG<br>GAAGGGGCTGGAATGGGTCTCAGGT<br>ATTAGTGGTAGTGGTGGTAGCACAT<br>ACTACGCAGACTCCGTGAAGGGCCG<br>GTTCACCATCTCCAGAGACAATTCC<br>AAGAACATGCTGTTTCTGCAAATGA<br>ACAGCCCGAGAGCCGAGGACACGG<br>CCGTATATTACTGTGCGAAGAAAAT<br>AGCAGCAGCTGGTAAGCAACCTGTT<br>GACTACTGGGGCCAGGGAACCCTGG<br>TCACCGTCTCCTCAGCATCCACCAA<br>GGGGCCTTCCGTGTTCCCCCTGGCC<br>CCTTGCTCCCGCTCGACCTCTGAATC<br>CACCGCCGCACTCGGTTGCCTGGTC<br>AAAGACTACTTCCCCGAGCCCGTGA<br>CTGTCTCGTGGAACTCGGGCGCCCT<br>CACATCCGGAGTGCATACCTTTCCC<br>GCCGTGTTGCAGTCCAGCGGCCTGT<br>ACAGCCTGAGCTCCGTCGTGACAGT<br>GCCGTCCTCCTCCCTTGGAACCAAG<br>ACCTATACCTGCAACGTCGACCACA<br>AGCCCTCCAACACCAAAGTGGACAA<br>GCGCGTCGAATCCAAGTACGGCCCC<br>CCTTGTCCGCCTTGTCCAGCCCCTGA<br>GTTCCTGGGTGGTCCGTCCGTGTTCC<br>TCTTCCCGCCCAAGCCGAAGGACAC<br>TCTGATGATTTCACGCACCCCGGAA<br>GTCACTTGCGTGGTCGTGGACGTGT<br>CGCAGGAAGATCCCGAAGTGCAGTT<br>CAATTGGTACGTGGATGGGGTCGAA<br>GTGCACAACGCCAAGACCAAGCCTA<br>GGGAAGAACAGTTCAACTCTACGTA<br>CCGGGTGGTGTCCGTGCTGACCGTG<br>CTGCACCAGGACTGGCTGAACGGAA<br>AGGAGTACAAGTGCAAAGTGTCAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 1989 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARRKVYDYVWG SYRLPGSVSYYFDYWGQGTLVTVSSA STKGPSVFPLAPCSRSTSESTAALGCLV KDYFPEPVTVSWNSGALTSGVHTFPA VLQSSGLYSLSSVVTVPSSSLGTKTYTC NVDHKPSNTKVDKRVESKYGPPCPPCP APEFLGGPSVFLFPPKPKDTLMISRTPE VTCVVVDVSQEDPEVQFNWYVDGVE VHNAKTKPREEQFNSTYRVVSVLTVL HQDWLNGKEYKCKVSNKGLPSSIEKTI SKAKGQPREPQVYTLPPSQEEMTKNQ VSLTCLVKGFYPSDIAVEWESNGQPEN NYKTTPPVLDSDGSFFLYSRLTVDKSR WQEGNVFSCSVMHEALHNHYTQKSLS LSLGK | SEQ ID 2097 | CAGGTGCAGCTACAGCAGTGGGGC GCAGGACTGTTGAAGCCTTCGGAGA CCCTGTCCCTCACCTGCGCTGTCTAT GGTGGCTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAAGGAAGGT GTATGATTACGTTTGGGGGAGTTAT CGCCTCCCCGGGTCGGTATCGTACT ACTTTGACTACTGGGGCCAGGGAAC CCTGGTCACCGTCTCCTCAGCATCC ACCAAGGGCCCTTCCGTGTTCCCCA TGGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1990 | QVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARLPGRAARPD YWGQGTLVTVSSASTKGPSVFPLAPCS RSTSESTAALGCLVKDYFPEPVTVSWN SGALTSGVHTFPAVLQSSGLYSLSSVV TVPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2098 | CAGGTCCAGCTGGTACAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGACTCCC GGGGAGAGCAGCTCGTCCAGACTAC TGGGGCCAGGGCACCCTGGTCACCG TCTCCTCAGCATCCACCAAGGGGCC TTCCGTGTTCCCCCTGGCCCCTTGCT CCCGCTCGACCTCTGAATCCACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCAAGACCTAT ACCTGCAACGTCGACCACAAGCCCT CCAACACCAAAGTGGACAAGCGCG TCGAATCCAAGTACGGCCCCCCTTG TCCGCCTTGTCCAGCCCCTGAGTTCC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCCGCAG GAAGATCCCGAAGTGCAGTTCAATT GGTACGTGGATGGGGTCGAAGTGCA CAACGCCAAGACCAAGCCTAGGGA AGAACAGTTCAACTCTACGTACCGG GTGGTGTCCGTGCTGACCGTGCTGC ACCAGGACTGGCTGAACGGAAAGG AGTACAAGTGCAAAGTGTCAAACA AGGGCCTCCCTTCATCCATCGAAAA GACCATCAGCAAGGCCAAGGGTCA ACCTAGGGAGCCCCAGGTCTACACT TTGCCGCCTAGCCAAGAAGAAATGA CTAAGAACCAAGTGTCCCTGACTTG CCTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1991 | QVTLKESGGGVVQPGRSLRLSCAASGF TFSSYAMHWVRQAPGKGLEWVAVISY DGSNKYYADSVKGRFTISRDNSKNTL YLQMNSLRAEDTAVYYCARGPGAVA GTKPKYYFDYWGQGTLVTVSSASTKG PSVFPLAPCSRSTSESTAALGCLVKDYF PEPVTVSWNSGALTSGVHTFPAVLQSS GLYSLSSVVTVPSSSLGTKTYTCNVDH KPSNTKVDKRVESKYGPPCPPCPAPEF LGGPSVFLFPPKPKDTLMISRTPEVTCV VVDVSQEDPEVQFNWYVDGVEVHNA KTKPREEQFNSTYRVVSVLTVLHQDW LNGKEYKCKVSNKGLPSSIEKTISKAK GQPREPQVYTLPPSQEEMTKNQVSLTC LVKGFYPSDIAVEWESNGQPENNYKT TPPVLDSDGSFFLYSRLTVDKSRWQEG NVFSCSVMHEALHNHYTQKSLSLSLG K | SEQ ID 2099 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGAGGCCC CGGGGCAGTGGCTGGTACTAAGCCA AAGTACTACTTTGACTACTGGGGCC AGGGAACCCTGGTCACCGTCTCCTC AGCATCCACCAAGGGGCCTTCCGTG TTCCCCCTGGCCCCTTGCTCCCGCTC GACCTCTGAATCCACCGCCGCACTC GGTTGCCTGGTCAAAGACTACTTCC CCGAGCCCGTGACTGTCTCGTGGAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCAAGACCTATACCTGCAA CGTCGACCACAAGCCCTCCAACACC AAAGTGGACAAGCGCGTCGAATCC AAGTACGGCCCCCCTTGTCCGCCTT GTCCAGCCCCTGAGTTCCTGGGTGG TCCGTCCGTGTTCCTCTTCCCGCCCA AGCCGAAGGACACTCTGATGATTTC ACGCACCCCGGAAGTCACTTGCGTG GTCGTGGACGTGTCGCAGGAAGATC CCGAAGTGCAGTTCAATTGGTACGT GGATGGGGTCGAAGTGCACAACGC CAAGACCAAGCCTAGGGAAGAACA GTTCAACTCTACGTACCGGGTGGTG TCCGTGCTGACCGTGCTGCACCAGG ACTGGCTGAACGGAAAGGAGTACA AGTGCAAAGTGTCAAACAAGGGCCT CCCTTCATCCATCGAAAAGACCATC AGCAAGGCCAAGGGTCAACCTAGG GAGCCCCAGGTCTACACTTTGCCGC CTAGCCAAGAAGAAATGACTAAGA ACCAAGTGTCCCTGACTTGCCTTGT CAAGGGCTTTTATCCGTCCGACATC GCCGTGGAGTGGGAGTCCAACGGA CAACCGGAGAACAACTACAAGACC ACCCCACCGGTGCTCGATTCCGATG GCTCCTTCTTCCTGTACTCCCGGCTG ACTGTGGACAAGTCAAGATGGCAG GAGGGAAACGTGTTCTCCTGCTCCG TGATGCACGAAGCGCTGCACAACCA TTACACCCAGAAATCACTGTCACTT TCGCTGGGAAAA |
| SEQ ID 1992 | EVQLVQSGGGVVQPGRSLRLSCAASG FTFSSYAMHWVRQAPGKGLEWVAVIS YDGSNKYYADSVKGRFTISRDNSKNT LYLQMNSLRAEDTAVYYCARATYYY DSSGYRFDYWGQGTLVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | SEQ ID 2100 | GAGGTCCAGCTGGTGCAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGGGCCAC GTATTACTATGATAGTAGTGGTTAT AGGTTTGACTACTGGGGCCAGGGAA CCCTGGTCACCGTCTCCTCAGCATC CACCAAGGGGCCTTCCGTGTTCCCC CTGGCCCCTTGCTCCCGCTCGACCTC TGAATCCACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCAAGACCTATACCTGCAACGTCG ACCACAAGCCCTCCAACACCAAAGT GGACAAGCGCGTCGAATCCAAGTAC GGCCCCCCTTGTCCGCCTTGTCCAG CCCCTGAGTTCCTGGGTGGTCCGTC CGTGTTCCTCTTCCCGCCCAAGCCG AAGGACACTCTGATGATTTCACGCA CCCCGGAAGTCACTTGCGTGGTCGT GGACGTGTCGCAGGAAGATCCCGA AGTGCAGTTCAATTGGTACGTGGAT GGGGTCGAAGTGCACAACGCCAAG ACCAAGCCTAGGGAAGAACAGTTC AACTCTACGTACCGGGTGGTGTCCG TGCTGACCGTGCTGCACCAGGACTG GCTGAACGGAAAGGAGTACAAGTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CAAAGTGTCAAACAAGGGCCTCCCT TCATCCATCGAAAAGACCATCAGCA AGGCCAAGGGTCAACCTAGGGAGC CCCAGGTCTACACTTTGCCGCCTAG CCAAGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |
| SEQ ID 1993 | EVQLVQSGGGLVEPGGSLRLSCAASRF TFSDAWMSWVRQAPGKGLEWVGRIK SKISGGTTDYAAPVQGRFTISRDDSKN TLYLQMDSLKTEDTAVYYCANRNLGY WGQGTLVTVSSASTKGPSVFPLAPCSR STSESTAALGCLVKDYFPEPVTVSWNS GALTSGVHTFPAVLQSSGLYSLSSVVT VPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2101 | GAGGTCCAGCTGGTACAGTCTGGGG GAGGCTTGGTAGAACCGGGGGGGT CCCTTAGACTCTCCTGTGCAGCCTCT CGATTCACTTTCAGTGACGCCTGGA TGAGCTGGGTCCGCCAGGCTCCAGG TAAGGGGCTGGAGTGGGTTGGCCGT ATTAAAAGCAAATAAGTGGTGGG ACAACAGACTACGCTGCACCCGTGC AAGGCAGATTCACCATCTCAAGAGA TGATTCAAAAAACACGCTGTATCTG CAAATGGACAGCCTGAAAACCGAG GACACAGCCGTGTATTACTGTGCGA ACCGAAACTTAGGCTACTGGGGCCA GGGCACCCTGGTGACCGTCTCCTCA GCATCCACCAAGGGGCCTTCCGTGT TCCCCCTGGCCCCTTGCTCCCGCTCG ACCTCTGAATCCACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1994 | EVQLVQSGAEVKKPGASVKVSCKASG YTFTSYAMHWVRQAPGQRLEWMGWI NAGNGNTKYSQKFQGRVTMTTDTSTS TAYMELRSLRSDDTAVYYCARARYYD SSGYIAPSGYFDYWGQGTLVTVSSAST KGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2102 | GAGGTCCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATGACCACAGACACATC CACGAGCACAGCCTACATGGAGCTG AGGAGCCTGAGATCTGACGACACG GCCGTGTATTACTGTGCGAGAGCTC GTTACTATGATAGTAGTGGTTATAT TGCCCCATCGGGTTACTTTGACTACT GGGGCCAGGGAACCCTGGTCACCGT CTCCTCAGCATCCACCAAGGGGCCT TCCGTGTTCCCCCTGGCCCCTTGCTC CCGCTCGACCTCTGAATCCACCGCC GCACTCGGTTGCCTGGTCAAAGACT ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCAAGACCTATA CCTGCAACGTCGACCACAAGCCCTC CAACACCAAAGTGGACAAGCGCGT CGAATCCAAGTACGGCCCCCCCTGT CCGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1995 | QVQLVQSGAEVKKPGASVKVSCKASG YTFTSYAMHWVRQAPGQRLEWMGWI NAGNGNTKYSQKFQGRVTITRDTSAST AYMELSSLRSEDTAVYYCARDGPAVD GAEYFQHWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2103 | CAGGTGCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATTACCAGGGACACATC CGCGAGCACAGCCTACATGGAGCTG AGCAGCCTGAGATCTGAAGACACG GCTGTGTATTACTGTGCGAGAGATG GCCCCGCCGTTGATGGTGCTGAATA CTTCCAGCACTGGGGCCAGGGCACC CTGGTCACCGTCTCCTCAGCATCCA CCAAGGGGCCTTCCGTGTTCCCCCT GGCCCCTTGCTCCCGCTCGACCTCT GAATCCACCGCCGCACTCGGTTGCC TGGTCAAAGACTACTTCCCCGAGCC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1996 | QLQLQESGPGLVKPSQTLSLTCAISGDS VSSNSAAWNWIRQSPSRGLEWLGRTY YRSKWYNDYAVSLKSRITINPDTSKNQ FSLQLNSVTPEDTAVYYCASLASGSPP PGDYWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2104 | CAGCTGCAGCTGCAGGAGTCGGGTC CAGGACTGGTGAAGCCCTCGCAGAC CCTCTCACTCACCTGTGCCATCTCCG GGGACAGTGTCTCTAGCAACAGTGC TGCTTGGAACTGGATCAGGCAGTCC CCATCGCGAGGCCTTGAGTGGCTGG GAAGGACTTACTACAGGTCCAAGTG GTATAATGATTATGCAGTATCTCTG AAAAGTCGAATAACCATCAACCCGG ACACATCCAAGAACCAGTTCTCCCT GCAGCTGAACTCTGTGACTCCCGAG GACACGGCTGTATATTACTGTGCAA GTTTGGCGAGTGGTTCCCCCCTCC GGGGGACTACTGGGGCCAGGGAAC CCTGGTGACCGTCTCCTCAGCATCC ACCAAGGGGCCTTCCGTGTTCCCCC TGGCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | AACGGAAAGGAGTACAAGTGCAAA GTGTCAAACAAGGGCCTCCCTTCAT CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 1997 | QVTLKESGGGVVQPGRSLRLSCAASGF TFSTYGMHWVRQAPGKGLEWVALISY DGSKKYYANSVKGRFTISRDNSKNTL YLQMKSLRAEDTAMYYCAKGPIVGAT MDYWGQGALVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2105 | CAGGTCACCTTGAAGGAGTCTGGGG GAGGCGTGGTCCAGCCTGGGAGGTC CCTGAGACTCTCCTGTGCAGCCTCT GGATTCACCTTCAGTACCTATGGCA TGCACTGGGTCCGCCAGGCTCCAGG CAAGGGGCTGGAGTGGGTGGCACTT ATATCATATGATGGAAGTAAAAAAT ACTATGCAAACTCCGTGAAGGGCCG ATTCACCATCTCCAGAGACAATTCC AAGAACACGTTGTATCTGCAAATGA AAAGTCTGAGAGCTGAGGACACGG CTATGTATTACTGTGCGAAAGGCCC TATAGTGGGAGCGACTATGGACTAC TGGGGCCAGGGAGCCCTGGTCACCG TCTCCTCAGCATCCACCAAGGGGCC TTCCGTGTTCCCCCTGGCCCCTTGCT CCCGCTCGACCTCTGAATCCACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCAAGACCTAT ACCTGCAACGTCGACCACAAGCCCT CCAACACCAAAGTGGACAAGCGCG TCGAATCCAAGTACGGCCCCCCTTG TCCGCCTTGTCCAGCCCTGAGTTCC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAG GAAGATCCCGAAGTGCAGTTCAATT GGTACGTGGATGGGGTCGAAGTGCA CAACGCCAAGACCAAGCCTAGGGA AGAACAGTTCAACTCTACGTACCGG GTGGTGTCCGTGCTGACCGTGCTGC ACCAGGACTGGCTGAACGGAAAGG AGTACAAGTGCAAAGTGTCAAACA AGGGCCTCCCTTCATCCATCGAAAA GACCATCAGCAAGGCCAAGGGTCA ACCTAGGGAGCCCCAGGTCTACACT TTGCCGCCTAGCCAAGAAGAAATGA CTAAGAACCAAGTGTCCCTGACTTG CCTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| SEQ ID 1998 | EVQLVQSGAEVKKPGSSVKVSCKASG GTFSSYAISWVRQAPGQGLEWMGWIS AYNGNTNYAQKLQGRVTMTTDTSTST AYMELRSLRSDDTAVYYCARWYGDY GLDYWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2106 | GAGGTGCAGCTGGTGCAGTCTGGGG CTGAGGTGAAGAAGCCTGGGTCCTC GGTGAAGGTCTCCTGCAAGGCTTCT GGAGGCACCTTCAGCAGCTATGCTA TCAGCTGGGTGCGACAGGCCCCTGG ACAAGGGCTTGAGTGGATGGGATG GATCAGCGCTTACAATGGTAACACA AACTATGCACAGAAGCTCCAGGGCA GAGTCACCATGACCACAGACACATC CACGAGCACAGCCTACATGGAGCTG AGGAGCCTGAGATCTGACGACACG GCCGTGTATTACTGTGCGAGATGGT ACGGTGACTACGGCCTTGACTACTG GGGCCAGGGAACCCTGGTCACCGTC TCCTCAGCATCCACCAAGGGGCCTT CCGTGTTCCCCCTGGCCCCTTGCTCC CGCTCGACCTCTGAATCCACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCAAGACCTATAC CTGCAACGTCGACCACAAGCCCTCC AACACCAAAGTGGACAAGCGCGTC GAATCCAAGTACGGCCCCCCTTGTC CGCCTTGTCCAGCCCCTGAGTTCCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCAGG AAGATCCCGAAGTGCAGTTCAATTG GTACGTGGATGGGGTCGAAGTGCAC AACGCCAAGACCAAGCCTAGGGAA GAACAGTTCAACTCTACGTACCGGG TGGTGTCCGTGCTGACCGTGCTGCA CCAGGACTGGCTGAACGGAAAGGA GTACAAGTGCAAAGTGTCAAACAA GGGCCTCCCTTCATCCATCGAAAAG ACCATCAGCAAGGCCAAGGGTCAA CCTAGGGAGCCCCAGGTCTACACTT TGCCGCCTAGCCAAGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCCG GCTGACTGTGGACAAGTCAAGATGG CAGGAGGGAAACGTGTTCTCCTGCT CCGTGATGCACGAAGCGCTGCACAA CCATTACACCCAGAAATCACTGTCA CTTTCGCTGGGAAAA |
| SEQ ID 1999 | EVQLVQSGAEVKKPGASVKVSCKASG YTFTSYAMHWVRQAPGQRLAWMGWI NAGNGNTKYSEKFEGRVTITRDTSAST AYMELSSLRSEDTAVYYCARVAKYYY ESGGYRASNWFDPWGQGTLVTVSSAS TKGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2107 | GAGGTCCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAGGGCTTGCGTGGATGGGATGG ATCAACGCTGGCAATGGTAACACAA AATATTCAGAGAAGTTCGAAGGCAG AGTCACCATCACCAGGGACACATCC GCGAGCACAGCCTACATGGAGCTGA GCAGCCTGAGATCTGAAGACACGGC TGTGTATTACTGTGCGAGGGTCGCC AAATATTATTACGAGAGTGGTGGTT ATCGGGCCTCCAACTGGTTCGACCC CTGGGGCCAGGGCACCCTGGTCACC GTCTCCTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCGTGGAACTCGGGCGCCCTCACAT
CCGGAGTGCATACCTTTCCCGCCGT
GTTGCAGTCCAGCGGCCTGTACAGC
CTGAGCTCCGTCGTGACAGTGCCGT
CCTCCTCCCTTGGAACCAAGACCTA
TACCTGCAACGTCGACCACAAGCCC
TCCAACACCAAAGTGGACAAGCGC
GTCGAATCCAAGTACGGCCCCCCCTT
GTCCGCCTTGTCCAGCCCCTGAGTT
CCTGGGTGGTCCGTCCGTGTTCCTCT
TCCCGCCCAAGCCGAAGGACACTCT
GATGATTTCACGCACCCCGGAAGTC
ACTTGCGTGGTCGTGGACGTGTCGC
AGGAAGATCCCGAAGTGCAGTTCAA
TTGGTACGTGGATGGGGTCGAAGTG
CACAACGCCAAGACCAAGCCTAGG
GAAGAACAGTTCAACTCTACGTACC
GGGTGGTGTCCGTGCTGACCGTGCT
GCACCAGGACTGGCTGAACGGAAA
GGAGTACAAGTGCAAAGTGTCAAA
CAAGGGCCTCCCTTCATCCATCGAA
AAGACCATCAGCAAGGCCAAGGGT
CAACCTAGGGAGCCCCAGGTCTACA
CTTTGCCGCCTAGCCAAGAAGAAAT
GACTAAGAACCAAGTGTCCCTGACT
TGCCTTGTCAAGGGCTTTTATCCGTC
CGACATCGCCGTGGAGTGGGAGTCC
AACGGACAACCGGAGAACAACTAC
AAGACCACCCCACCGGTGCTCGATT
CCGATGGCTCCTTCTTCCTGTACTCC
CGGCTGACTGTGGACAAGTCAAGAT
GGCAGGAGGGAAACGTGTTCTCCTG
CTCCGTGATGCACGAAGCGCTGCAC
AACCATTACACCCAGAAATCACTGT
CACTTTCGCTGGGAAAA |
| SEQ ID 2000 | QVQLQESGPGLVKPSQTLSLTCAISGD
SVSSNSAAWNWIRQSPSRGLEWLGRT
YYRSKWYNDYAVSVKSRITINPDTSKN
QFSLQLNSVTPEDTAVYYCARAPPPTV
GWYAPVFDYWGQGTLVTVSSASTKGP
SVFPLAPCSRSTSESTAALGCLVKDYFP
EPVTVSWNSGALTSGVHTFPAVLQSSG
LYSLSSVVTVPSSSLGTKTYTCNVDHK
PSNTKVDKRVESKYGPPCPPCPAPEFL
GGPSVFLFPPKPKDTLMISRTPEVTCVV
VDVSQEDPEVQFNWYVDGVEVHNAK
TKPREEQFNSTYRVVSVLTVLHQDWL
NGKEYKCKVSNKGLPSSIEKTISKAKG
QPREPQVYTLPPSQEEMTKNQVSLTCL
VKGFYPSDIAVEWESNGQPENNYKTTP
PVLDSDGSFFLYSRLTVDKSRWQEGN
VFSCSVMHEALHNHYTQKSLSLSLGK | SEQ ID 2108 | CAGGTGCAGCTGCAGGAGTCAGGTC
CAGGACTGGTGAAGCCCTCGCAGAC
CCTCTCACTCACCTGTGCCATCTCCG
GGGACAGTGTCTCTAGCAACAGTGC
TGCTTGGAACTGGATCAGGCAGTCC
CCATCGAGAGGCCTTGAGTGGCTGG
GAAGGACATACTACAGGTCCAAGTG
GTATAATGATTATGCAGTATCTGTG
AAAAGTCGAATAACCATCAACCCAG
ACACATCCAAGAACCAGTTCTCCCT
GCAGCTGAACTCTGTGACTCCCGAG
GACACGGCTGTGTATTACTGTGCAA
GAGCGCCCCCTCCGACTGTTGGCTG
GTACGCCCCCGTCTTTGACTACTGG
GGCCAGGGAACCCTGGTCACCGTCT
CCTCAGCATCCACCAAGGGGCCTTC
CGTGTTCCCCCTGGCCCCTTGCTCCC
GCTCGACCTCTGAATCCACCGCCGC
ACTCGGTTGCCTGGTCAAAGACTAC
TTCCCCGAGCCCGTGACTGTCTCGT
GGAACTCGGGCGCCCTCACATCCGG
AGTGCATACCTTTCCCGCCGTGTTG
CAGTCCAGCGGCCTGTACAGCCTGA
GCTCCGTCGTGACAGTGCCGTCCTC
CTCCCTTGGAACCAAGACCTATACC
TGCAACGTCGACCACAAGCCCTCCA
ACACCAAAGTGGACAAGCGCGTCG
AATCCAAGTACGGCCCCCCTTGTCC
GCCTTGTCCAGCCCCTGAGTTCCTG
GGTGGTCCGTCCGTGTTCCTCTTCCC
GCCCAAGCCGAAGGACACTCTGATG
ATTTCACGCACCCCGGAAGTCACTT
GCGTGGTCGTGGACGTGTCGCAGGA
AGATCCCGAAGTGCAGTTCAATTGG
TACGTGGATGGGGTCGAAGTGCACA
ACGCCAAGACCAAGCCTAGGGAAG
AACAGTTCAACTCTACGTACCGGGT
GGTGTCCGTGCTGACCGTGCTGCAC
CAGGACTGGCTGAACGGAAAGGAG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TACAAGTGCAAAGTGTCAAACAAG GGCCTCCCTTCATCCATCGAAAAGA CCATCAGCAAGGCCAAGGGTCAACC TAGGGAGCCCCAGGTCTACACTTTG CCGCCTAGCCAAGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCCGGC TGACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 2001 | QLQLQESGGGLVQPGGSLRLSCSASGI SFRDYWMHWIRQTPGKGLVWVSRINP DGSSTSYADSVKGRFTISRDNSKNTLY LQMNSLRAEDTAVYYCAKVTGRRVG AHDYWGQGTLVTVSSASTKGPSVFPL APCSRSTSESTAALGCLVKDYFPEPVT VSWNSGALTSGVHTFPAVLQSSGLYSL SSVVTVPSSSLGTKTYTCNVDHKPSNT KVDKRVESKYGPPCPPCPAPEFLGGPS VFLFPPKPKDTLMISRTPEVTCVVVDV SQEDPEVQFNWYVDGVEVHNAKTKP REEQFNSTYRVVSVLTVLHQDWLNGK EYKCKVSNKGLPSSIEKTISKAKGQPRE PQVYTLPPSQEEMTKNQVSLTCLVKGF YPSDIAVEWESNGQPENNYKTTPPVLD SDGSFFLYSRLTVDKSRWQEGNVFSCS VMHEALHNHYTQKSLSLSLGK | SEQ ID 2109 | CAGCTGCAGCTGCAGGAGTCCGGGG GAGGCTTAGTTCAGCCGGGGGGGTC CCTGAGACTCTCCTGCTCAGCCTCT GGAATCAGCTTCAGAGATTACTGGA TGCACTGGATCCGCCAAACTCCAGG GAAGGGGCTGGTGTGGGTCTCACGT ATTAATCCTGATGGGAGTAGCACAA GCTACGCGGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAAGTTAC GGGACGGAGGTGGGAGCCCATGA CTACTGGGGCCAGGGAACCCTGGTC ACCGTCTCCTCAGCATCCACCAAGG GGCCTTCCGTGTTCCCCCTGGCCCCT TGCTCCCGCTCGACCTCTGAATCCA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCAAGAC CTATACCTGCAACGTCGACCACAAG CCCTCCAACACCAAAGTGGACAAGC GCGTCGAATCCAAGTACGGCCCCCC TTGTCCGCCTTGTCCAGCCCCTGAGT TCCTGGGTGGTCCGTCCGTGTTCCTC TTCCCGCCCAAGCCGAAGGACACTC TGATGATTTCACGCACCCCGGAAGT CACTTGCGTGGTCGTGGACGTGTCG CAGGAAGATCCCGAAGTGCAGTTCA ATTGGTACGTGGATGGGGTCGAAGT GCACAACGCCAAGACCAAGCCTAG GGAAGAACAGTTCAACTCTACGTAC CGGGTGGTGTCCGTGCTGACCGTGC TGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |

TABLE 39-continued

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| SEQ ID 2002 | QVQLVQSGAEVKKPGASVKVSCKASG YTFTGYYMHWVRQAPGQGLEWMGW INPNSGGTNYAQKFQGRVTMTRDTSIS TAYMELSRLRSDDTAVYYCAFAQPGA ETLNFDLWGRGTLVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2110 | CAGGTGCAGCTGGTGCAGTCTGGGG CTGAGGTGAAGAAGCCTGGGGCCTC AGTGAAGGTCTCCTGCAAGGCTTCT GGATACACCTTCACCGGCTACTATA TGCACTGGGTGCGACAGGCCCCTGG ACAAGGGCTTGAGTGGATGGGATG GATCAACCCTAACAGTGGTGGCACA AACTATGCACAGAAGTTTCAGGGCA GGGTCACCATGACCAGGGACACGTC CATCAGCACAGCCTACATGGAGCTG AGCAGGCTGAGATCTGACGACACG GCCGTGTATTACTGTGCCTTTGCCCA GCCGGGCGCTGAGACGTTGAACTTC GATCTCTGGGGCCGTGGCACCCTGG TCACCGTCTCCTCAGCATCCACCAA GGGGCCTTCCGTGTTCCCCCTGGCC CCTTGCTCCCGCTCGACCTCTGAATC CACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCAAG ACCTATACCTGCAACGTCGACCACA AGCCCTCCAACACCAAAGTGGACAA GCGCGTCGAATCCAAGTACGGCCCC CCTTGTCCGGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 2003 | QVQLQQSGPGLVKPSQTLSLTCAISGD SVSSKSAAWNWIRQSPSRGLEWLGRT YYRSKWNNDYALSVKSRITINPDTSKN QFSLQLKSVTPEDTALYYCVRQVAGG MDVWGQGTTVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2111 | CAGGTACAGCTGCAGCAGTCAGGTC CAGGACTGGTGAAGCCCTCGCAGAC CCTCTCACTCACCTGTGCCATCTCCG GGGACAGTGTCTCTAGCAAAAGTGC TGCTTGGAACTGGATCAGGCAGTCC CCATCGAGAGGCCTTGAGTGGCTGG GAAGGACATACTACAGGTCCAAATG GAATAATGATTATGCATTATCTGTG AAAAGTCGAATAACCATCAACCCAG ACACATCCAAGAACCAGTTCTCCCT GCAGCTGAAGTCTGTGACTCCCGAG GACACGGCTCTGTATTACTGTGTAA GACAAGTCGCGGGCGGTATGGACGT CTGGGGCCAAGGGACCACGGTCACC GTCTCCTCAGCATCCACCAAGGGCC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT |

TABLE 39-continued

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| | | | CCGGAGTGCATACCTTTCCCGCCGT |
| | | | GTTGCAGTCCAGCGGCCTGTACAGC |
| | | | CTGAGCTCCGTCGTGACAGTGCCGT |
| | | | CCTCCTCCCTTGGAACCAAGACCTA |
| | | | TACCTGCAACGTCGACCACAAGCCC |
| | | | TCCAACACCAAAGTGGACAAGCGC |
| | | | GTCGAATCCAAGTACGGCCCCCCTT |
| | | | GTCCGCCTTGTCCAGCCCCTGAGTT |
| | | | CCTGGGTGGTCCGTCCGTGTTCCTCT |
| | | | TCCCGCCCAAGCCGAAGGACACTCT |
| | | | GATGATTTCACGCACCCCGGAAGTC |
| | | | ACTTGCGTGGTCGTGGACGTGTCGC |
| | | | AGGAAGATCCCGAAGTGCAGTTCAA |
| | | | TTGGTACGTGGATGGGGTCGAAGTG |
| | | | CACAACGCCAAGACCAAGCCTAGG |
| | | | GAAGAACAGTTCAACTCTACGTACC |
| | | | GGGTGGTGTCCGTGCTGACCGTGCT |
| | | | GCACCAGGACTGGCTGAACGGAAA |
| | | | GGAGTACAAGTGCAAAGTGTCAAA |
| | | | CAAGGGCCTCCCTTCATCCATCGAA |
| | | | AAGACCATCAGCAAGGCCAAGGGT |
| | | | CAACCTAGGGAGCCCCAGGTCTACA |
| | | | CTTTTGCCGCCTAGCCAAGAAGAAAT |
| | | | GACTAAGAACCAAGTGTCCCTGACT |
| | | | TGCCTTGTCAAGGGCTTTTATCCGTC |
| | | | CGACATCGCCGTGGAGTGGGAGTCC |
| | | | AACGGACAACCGGAGAACAACTAC |
| | | | AAGACCACCCCACCGGTGCTCGATT |
| | | | CCGATGGCTCCTTCTTCCTGTACTCC |
| | | | CGGCTGACTGTGGACAAGTCAAGAT |
| | | | GGCAGGAGGGAAACGTGTTCTCCTG |
| | | | CTCCGTGATGCACGAAGCGCTGCAC |
| | | | AACCATTACACCCAGAAATCACTGT |
| | | | CACTTTCGCTGGGAAAA |
| SEQ ID 2004 | QVQLVQSGGGLVQPGRSLRLSCTASGF TFGDYAMSWFRQAPGKGLEWVSAISG SGGSTYYADSVKGRFTISRDNSKNTLY LQMNSLRAEDTAVYYCAKGSVYSGSY YMLIDYWGQGTLVTVSSASTKGPSVFP LAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2112 | CAGGTGCAGCTGGTGCAATCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTCTCAGCTA TTAGTGGTAGTGGTGGTAGCACATA CTATGCAGACTCCGTGAAGGGCCGA TTCACCATCTCCAGAGACAATTCCA AGAACACGCTGTATCTGCAAATGAA CAGCCTGAGAGCTGAGGACACGGCT GTGTATTACTGTGCGAAAGGATCGG TATATAGTGGGAGCTACTATATGCT CATTGACTACTGGGGCCAGGGCACC CTGGTCACCGTCTCCTCAGCATCCA CCAAGGGCCCATCCGTCTTCCCCCT GGCCCCCTTGCTCCCGCTCGACCTCT GAATCCACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCAAGACCTATACCTGCAACGTCGA CCACAAGCCCTCCAACACCAAAGTG GACAAGCGCGTCGAATCCAAGTACG GCCCCCCTTGTCCGCCTTGTCCAGCC CCTGAGTTCCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCAGGAAGATCCCGAAGT GCAGTTCAATTGGTACGTGGATGGG GTCGAAGTGCACAACGCCAAGACC AAGCCTAGGGAAGAACAGTTCAACT CTACGTACCGGGTGGTGTCCGTGCT GACCGTGCTGCACCAGGACTGGCTG AACGGAAAGGAGTACAAGTGCAAA GTGTCAAACAAGGGCCTCCCTTCAT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCATCGAAAAGACCATCAGCAAGG CCAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 2005 | QVQLQQSGPGLVRPSQTLSLTCVISGD SVSSGSAAWNWIRQSPSRGLEWLGRT YYRAKWYNEYAGSVKSRITISPDTSKN QFSLQLNSVTPEDTAVYFCTRQDKDNT RYSGLGVWGQGTTVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2113 | CAGGTACAGCTGCAGCAGTCAGGTC CAGGACTGGTGAGGCCCTCGCAGAC CCTCTCACTCACCTGTGTCATCTCCG GGGACAGTGTCTCTAGCGGCAGTGC TGCTTGGAACTGGATCAGGCAGTCC CCATCGAGAGGCCTTGAGTGGCTGG GAAGGACATATTATAGGGCCAAGTG GTATAATGAATATGCAGGGTCTGTG AAAAGCCGAATAACCATCAGTCCGG ACACATCCAAGAACCAGTTCTCCCT GCAACTGAACTCTGTGACTCCCGAG GACACGGCTGTGTATTTCTGTACAA GACAAGACAAAGACAACACGAGAT ATTCCGGTTTGGGCGTCTGGGGCCA AGGGACCACGGTGACCGTCTCCTCA GCATCCACCAAGGGGCCTTCCGTGT TCCCCCTGGCCCCTTGCTCCCGCTCG ACCTCTGAATCCACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
| --- | --- | --- | --- |
| SEQ ID 2006 | EVQLVETGGGLVQPGGSLRLSCAASEF TLRNYGVSWVRQAPGKGLEWVSGMS GSGYSTYYADSVKGRFTISRDSSKNTL FLQMDSLRAEDTAIYYCARGPRMWSS GIDAFDIWGHGTMVTVSSASTKGPSVF PLAPCSRSTSESTAALGCLVKDYFPEPV TVSWNSGALTSGVHTFPAVLQSSGLYS LSSVVTVPSSSLGTKTYTCNVDHKPSN TKVDKRVESKYGPPCPPCPAPEFLGGP SVFLFPPKPKDTLMISRTPEVTCVVVD VSQEDPEVQFNWYVDGVEVHNAKTK PREEQFNSTYRVVSVLTVLHQDWLNG KEYKCKVSNKGLPSSIEKTISKAKGQP REPQVYTLPPSQEEMTKNQVSLTCLVK GFYPSDIAVEWESNGQPENNYKTTPPV LDSDGSFFLYSRLTVDKSRWQEGNVFS CSVMHEALHNHYTQKSLSLSLGK | SEQ ID 2114 | GAGGTGCAGCTGGTGGAGACCGGG GGAGGCTTAGTTCAGCCTGGGGGGT CCCTGAGACTCTCCTGTGCAGCCTC TGAATTCACCCTTAGGAACTATGGC GTGAGCTGGGTCCGCCAGGCTCCAG GGAAGGGGCTGGAGTGGGTCTCAG GTATGAGTGGTAGTGGTTATAGTAC ATACTACGCAGACTCCGTGAAGGGC CGGTTCACCATCTCCAGAGACAGTT CCAAGAACACGCTGTTTCTGCAAAT GGACAGCCTGAGAGCCGAGGACAC GGCCATATATTACTGTGCGAGAGGG CCCCGAATGTGGAGCAGTGGCATTG ATGCTTTTGATATCTGGGGCCACGG GACAATGGTGACCGTCTCTTCAGCA TCCACCAAGGGGCCTTCCGTGTTCC CCCTGGCCCCTTGCTCCCGCTCGAC CTCTGAATCCACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCAAGACCTATACCTGCAACG TCGACCACAAGCCCTCCAACACCAA AGTGGACAAGCGCGTCGAATCCAA GTACGGCCCCCCTTGTCCGGCCTTGTC CAGCCCCTGAGTTCCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCAGGAAGATCCCG AAGTGCAGTTCAATTGGTACGTGGA TGGGGTCGAAGTGCACAACGCCAA GACCAAGCCTAGGGAAGAACAGTT CAACTCTACGTACCGGGTGGTGTCC GTGCTGACCGTGCTGCACCAGGACT GGCTGAACGGAAAGGAGTACAAGT GCAAAGTGTCAAACAAGGGCCTCCC TTCATCCATCGAAAAGACCATCAGC AAGGCCAAGGGTCAACCTAGGGAG CCCCAGGTCTACACTTTGCCGCCTA GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 2007 | QVQLQQWGAGLLKPSETLSLTCAVYG GSVSGYYWSWIRQPPGKGLEWMGEIH HSGSTNYNPSLKSRVTISLDTPKNQFSL KLSSVTAADTAVYYCARRDWAGKRV WGQGTLVTVSSASTKGPSVFPLAPCSR STSESTAALGCLVKDYFPEPVTVSWNS GALTSGVHTFPAVLQSSGLYSLSSVVT VPSSSLGTKTYTCNVDHKPSNTKVDK RVESKYGPPCPPCPAPEFLGGPSVFLFP PKPKDTLMISRTPEVTCVVVDVSQEDP EVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2115 | CAGGTGCAGCTACAGCAGTGGGGC GCAGGACTGTTGAAGCCTTCGGAGA CCCTGTCCCTCACCTGCGCTGTCTAT GGTGGGTCCGTCAGTGGTTACTACT GGAGCTGGATCCGCCAGCCCCCAGG GAAGGGGCTGGAGTGGATGGGGA AATCCATCATAGTGGAAGCACCAAC TACAACCCGTCCCTCAAGAGTCGAG TCACCATATCACTAGACACGCCCAA GAACCAGTTCTCCCTGAAGCTAAGC TCTGTGACCGCCGCGGACACGGCTG TATATTACTGTGCGAGACGGGATTG GGCAGGAAAAGGGTCTGGGGCCA GGGACCCTGGTCACCGTCTCCTCA GCATCCACCAAGGGGCCTTCCGTGT TCCCCCTGGCCCCTTGCTCCCGCTCG ACCTCTGAATCCACCGCCGCACTCG GTTGCCTGGTCAAAGACTACTTCCC CGAGCCCGTGACTGTCTCGTGGAAC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCGGGCGCCCTCACATCCGGAGTGC<br>ATACCTTTCCCGCCGTGTTGCAGTCC<br>AGCGGCCTGTACAGCCTGAGCTCCG<br>TCGTGACAGTGCCGTCCTCCTCCCTT<br>GGAACCAAGACCTATACCTGCAACG<br>TCGACCACAAGCCCTCCAACACCAA<br>AGTGGACAAGCGCGTCGAATCCAA<br>GTACGGCCCCCCTTGTCCGCCTTGTC<br>CAGCCCCTGAGTTCCTGGGTGGTCC<br>GTCCGTGTTCCTCTTCCCGCCCAAGC<br>CGAAGGACACTCTGATGATTTCACG<br>CACCCCGGAAGTCACTTGCGTGGTC<br>GTGGACGTGTCGCAGGAAGATCCCG<br>AAGTGCAGTTCAATTGGTACGTGGA<br>TGGGGTCGAAGTGCACAACGCCAA<br>GACCAAGCCTAGGGAAGAACAGTT<br>CAACTCTACGTACCGGGTGGTGTCC<br>GTGCTGACCGTGCTGCACCAGGACT<br>GGCTGAACGGAAAGGAGTACAAGT<br>GCAAAGTGTCAAACAAGGGCCTCCC<br>TTCATCCATCGAAAAGACCATCAGC<br>AAGGCCAAGGGTCAACCTAGGGAG<br>CCCCAGGTCTACACTTTGCCGCCTA<br>GCCAAGAAGAAATGACTAAGAACC<br>AAGTGTCCCTGACTTGCCTTGTCAA<br>GGGCTTTTATCCGTCCGACATCGCC<br>GTGGAGTGGGAGTCCAACGGACAA<br>CCGGAGAACAACTACAAGACCACC<br>CCACCGGTGCTCGATTCCGATGGCT<br>CCTTCTTCCTGTACTCCCGGCTGACT<br>GTGGACAAGTCAAGATGGCAGGAG<br>GGAAACGTGTTCTCCTGCTCCGTGA<br>TGCACGAAGCGCTGCACAACCATTA<br>CACCCAGAAATCACTGTCACTTTCG<br>CTGGGAAAA |
| SEQ ID 2008 | QVQLQQSGPGLLKPSQTLSLTCAISGD SVSSNTATWNWIRQSPSRGLEWLGRT YYRSKWYKDNALSVKSRITINPDTSKN QFSLQLNSVTPEDTAVYYCAGGRAGIA AFDIWGQGTTVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2116 | CAGGTACAGCTGCAGCAGTCAGGTC<br>CAGGACTATTAAAGCCCTCGCAGAC<br>CCTCTCACTCACCTGTGCCATCTCCG<br>GGGACAGTGTCTCTAGCAACACTGC<br>TACTTGGAACTGGATCAGGCAGTCC<br>CCATCGAGAGGCCTTGAGTGGCTGG<br>GAAGGACATACTACAGGTCCAAGTG<br>GTATAAGGATAATGCACTGTCTGTG<br>AAAAGTCGAATAACCATCAACCCAG<br>ACACATCCAAGAACCAGTTCTCCCT<br>GCAGCTGAACTCTGTGACTCCCGAG<br>GACACGGCTGTGTATTACTGTGCAG<br>GAGGTCGGGCTGGTATTGCCGCTTT<br>TGATATCTGGGGCCAAGGGACCACG<br>GTCACCGTCTCCTCAGCATCCACCA<br>AGGGGCCTTCCGTGTTCCCCCTGGC<br>CCCTTGCTCCCGCTCGACCTCTGAAT<br>CCACCGCCGCACTCGGTTGCCTGGT<br>CAAAGACTACTTCCCCGAGCCCGTG<br>ACTGTCTCGTGGAACTCGGGCGCCC<br>TCACATCCGGAGTGCATACCTTTCC<br>CGCCGTGTTGCAGTCCAGCGGCCTG<br>TACAGCCTGAGCTCCGTCGTGACAG<br>TGCCGTCCTCCTCCCTTGGAACCAA<br>GACCTATACCTGCAACGTCGACCAC<br>AAGCCCTCCAACACCAAAGTGGACA<br>AGCGCGTCGAATCCAAGTACGGCCC<br>CCCTTGTCCGCCTTGTCCAGCCCCTG<br>AGTTCCTGGGTGGTCCGTCCGTGTT<br>CCTCTTCCCGCCCAAGCCGAAGGAC<br>ACTCTGATGATTTCACGCACCCCGG<br>AAGTCACTTGCGTGGTCGTGGACGT<br>GTCGCAGGAAGATCCCGAAGTGCA<br>GTTCAATTGGTACGTGGATGGGGTC<br>GAAGTGCACAACGCCAAGACCAAG<br>CCTAGGGAAGAACAGTTCAACTCTA<br>CGTACCGGGTGGTGTCCGTGCTGAC<br>CGTGCTGCACCAGGACTGGCTGAAC<br>GGAAAGGAGTACAAGTGCAAAGTG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | TCAAACAAGGGCCTCCCTTCATCCA TCGAAAAGACCATCAGCAAGGCCA AGGGTCAACCTAGGGAGCCCCAGGT CTACACTTTGCCGCCTAGCCAAGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCCGGCTGACTGTGGACAAGTC AAGATGGCAGGAGGGAAACGTGTT CTCCTGCTCCGTGATGCACGAAGCG CTGCACAACCATTACACCCAGAAAT CACTGTCACTTTCGCTGGGAAAA |
| SEQ ID 2009 | QVQLVQSGGGLIQPGGSLRLSCAASGF TVSSNYMSWVRQAPGKGLEWVSLIYS DGRTNYADSVKGRFTISRDNSKNTLYL QMNSLRAEDTAVYYCAKGALQGEWR RFDYWGQGTLVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2117 | CAGGTGCAGCTGGTGCAATCTGGAG GAGGCTTGATCCAGCCTGGGGGGTC CCTGAGACTCTCCTGTGCAGCCTCT GGGTTCACCGTCAGTAGCAACTACA TGAGCTGGGTCCGCCAGGCTCCAGG GAAGGGGCTGGAATGGGTCTCACTT ATTTATAGTGATGGTCGCACAAACT ATGCAGACTCCGTGAAGGGCCGATT CACCATCTCCAGAGACAATTCCAAG AACACGCTGTATCTGCAAATGAACA GCCTGAGAGCCGAGGACACGGCCG TATATTACTGTGCGAAGGGGGCCCT ACAGGGCGAATGCGGAGATTTGA CTACTGGGGCCAGGGCACCCTGGTC ACCGTCTCCTCAGCATCCACCAAGG GGCCTTCCGTGTTCCCCCTGGCCCCT TGCTCCCGCTCGACCTCTGAATCCA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCAAGAC CTATACCTGCAACGTCGACCACAAG CCCTCCAACACCAAAGTGGACAAGC GCGTCGAATCCAAGTACGGCCCCCC TTGTCCGCCTTGTCCAGCCCCTGAGT TCCTGGGTGGTCCGTCCGTGTTCCTC TTCCCGCCCAAGCCGAAGGACACTC TGATGATTTCACGCACCCCGGAAGT CACTTGCGTGGTCGTGGACGTGTCG CAGGAAGATCCCGAAGTGCAGTTCA ATTGGTACGTGGATGGGGTCGAAGT GCACAACGCCAAGACCAAGCCTAG GGAAGAACAGTTCAACTCTACGTAC CGGGTGGTGTCCGTGCTGACCGTGC TGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 2010 | QVQLQQSGPGLVKPSQTLSLTCAISGD SVSSNSAAWNWIRQSPSRGLEWLGRT YYRSKWYNDYAVSVKSRITINPDTSKN QFSLQLNSVTPEDTAVYYCTRTNQGY | SEQ ID 2118 | CAGGTGCAGCTACAGCAGTCAGGTC CAGGACTGGTGAAGCCCTCGCAGAC CCTCTCACTCACCTGTGCCATCTCCG GGGACAGTGTCTCTAGCAACAGTGC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | GGNSGVFDYWGQGTLVTVSSASTKGP SVFPLAPCSRSTSESTAALGCLVKDYFP EPVTVSWNSGALTSGVHTFPAVLQSSG LYSLSSVVTVPSSSLGTKTYTCNVDHK PSNTKVDKRVESKYGPPCPPCPAPEFL GGPSVFLFPPKPKDTLMISRTPEVTCVV VDVSQEDPEVQFNWYVDGVEVHNAK TKPREEQFNSTYRVVSVLTVLHQDWL NGKEYKCKVSNKGLPSSIEKTISKAKG QPREPQVYTLPPSQEEMTKNQVSLTCL VKGFYPSDIAVEWESNGQPENNYKTTP PVLDSDGSFFLYSRLTVDKSRWQEGN VFSCSVMHEALHNHYTQKSLSLSLGK | | TGCTTGGAACTGGATCAGGCAGTCC CCATCGAGAGGCCTTGAGTGGCTGG GAAGGACATATTACAGGTCCAAGTG GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGGCTGTGTATTACTGTACAA GAACCAACCAGGGATACGGTGGTA ACTCCGGGGTATTTGACTACTGGGG CCAGGGAACCCTGGTCACCGTCTCC TCAGCATCCACCAAGGGGCCTTCCG TGTTCCCCCTGGCCCCTTGCTCCCGC TCGACCTCTGAATCCACCGCCGCAC TCGGTTGCCTGGTCAAAGACTACTT CCCCGAGCCCGTGACTGTCTCGTGG AACTCGGGCGCCCTCACATCCGGAG TGCATACCTTTCCCGCCGTGTTGCA GTCCAGCGGCCTGTACAGCCTGAGC TCCGTCGTGACAGTGCCGTCCTCCT CCCTTGGAACCAAGACCTATACCTG CAACGTCGACCACAAGCCCTCCAAC ACCAAAGTGGACAAGCGCGTCGAA TCCAAGTACGGCCCCCCTTGTCCGC CTTGTCCAGCCCTGAGTTCCTGGG TGGTCCGTCCGTGTTCCTCTTCCCGC CCAAGCCGAAGGACACTCTGATGAT TTCACGCACCCCGGAAGTCACTTGC GTGGTCGTGGACGTGTCGCAGGAAG ATCCCGAAGTGCAGTTCAATTGGTA CGTGGATGGGTCGAAGTGCACAAC GCCAAGACCAAGCCTAGGGAAGAA CAGTTCAACTCTACGTACCGGGTGG TGTCCGTGCTGACCGTGCTGCACCA GGACTGGCTGAACGGAAAGGAGTA CAAGTGCAAAGTGTCAAACAAGGG CCTCCCTTCATCCATCGAAAAGACC ATCAGCAAGGCCAAGGGTCAACCTA GGGAGCCCCAGGTCTACACTTTGCC GCCTAGCCAAGAAGAAATGACTAA GAACCAAGTGTCCCTGACTTGCCTT GTCAAGGGCTTTTATCCGTCCGACA TCGCCGTGGAGTGGGAGTCCAACGG ACAACCGGAGAACAACTACAAGAC CACCCCACCGGTGCTCGATTCCGAT GGCTCCTTCTTCCTGTACTCCCGGCT GACTGTGGACAAGTCAAGATGGCA GGAGGGAAACGTGTTCTCCTGCTCC GTGATGCACGAAGCGCTGCACAACC ATTACACCCAGAAATCACTGTCACT TTCGCTGGGAAAA |
| SEQ ID 2011 | QVQLQQSGPGLVKPSQTLSLTCAISGD SVSGNSAAWNWIRQSPSRGLEWLGRT YYRSKWYNDYAVSVKSRITINPDTSKN QFSLQLNSVTPEDTAVYYCARIVGGAV DCWGQGTLVTVSSASTKGPSVFPLAPC SRSTSESTAALGCLVKDYFPEPVTVSW NSGALTSGVHTFPAVLQSSGLYSLSSV VTVPSSSLGTKTYTCNVDHKPSNTKVD KRVESKYGPPCPPCPAPEFLGGPSVFLF PPKPKDTLMISRTPEVTCVVVDVSQED PEVQFNWYVDGVEVHNAKTKPREEQF NSTYRVVSVLTVLHQDWLNGKEYKC KVSNKGLPSSIEKTISKAKGQPREPQVY TLPPSQEEMTKNQVSLTCLVKGFYPSD IAVEWESNGQPENNYKTTPPVLDSDGS FFLYSRLTVDKSRWQEGNVFSCSVMH EALHNHYTQKSLSLSLGK | SEQ ID 2119 | CAGGTGCAGCTACAGCAGTCAGGTC CAGGACTGGTGAAGCCCTCGCAGAC CCTCTCACTCACCTGTGCCATCTCCG GGGACAGTGTCTCTGGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGTTGAATTCTGTGACTCCCGAG GACACGGCTGTGTATTACTGTGCGA GGATAGTGGGAGGTGCCGTTGACTG CTGGGGCCAGGGAACCCTGGTGACC GTCTCCTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCTCCTCCCTTGGAACCAAGACCTA<br>TACCTGCAACGTCGACCACAAGCCC<br>TCCAACACCAAAGTGGACAAGCGC<br>GTCGAATCCAAGTACGGCCCCCCCTT<br>GTCCGCCTTGTCCAGCCCCTGAGTT<br>CCTGGGTGGTCCGTCCGTGTTCCTCT<br>TCCCGCCCAAGCCGAAGGACACTCT<br>GATGATTTCACGCACCCCGGAAGTC<br>ACTTGCGTGGTCGTGGACGTGTCGC<br>AGGAAGATCCCGAAGTGCAGTTCAA<br>TTGGTACGTGGATGGGGTCGAAGTG<br>CACAACGCCAAGACCAAGCCTAGG<br>GAAGAACAGTTCAACTCTACGTACC<br>GGGTGGTGTCCGTGCTGACCGTGCT<br>GCACCAGGACTGGCTGAACGGAAA<br>GGAGTACAAGTGCAAAGTGTCAAA<br>CAAGGGCCTCCCTTCATCCATCGAA<br>AAGACCATCAGCAAGGCCAAGGGT<br>CAACCTAGGGAGCCCCAGGTCTACA<br>CTTTGCCGCCTAGCCAAGAAGAAAT<br>GACTAAGAACCAAGTGTCCCTGACT<br>TGCCTTGTCAAGGGCTTTTATCCGTC<br>CGACATCGCCGTGGAGTGGGAGTCC<br>AACGGACAACCGGAGAACAACTAC<br>AAGACCACCCCACCGGTGCTCGATT<br>CCGATGGCTCCTTCTTCCTGTACTCC<br>CGGCTGACTGTGGACAAGTCAAGAT<br>GGCAGGAGGGAAACGTGTTCTCCTG<br>CTCCGTGATGCACGAAGCGCTGCAC<br>AACCATTACACCCAGAAATCACTGT<br>CACTTTCGCTGGGAAAA |
| SEQ ID 2012 | EVQLVQSGAEVKKPGASVKVSCKASG<br>YTFTSYAMHWVRQAPGQRLEWMGWI<br>NAGNGNTKYSQKFQGRVTITRDTSAST<br>AYMELSSLRSEDTAVYYCARVRVGAT<br>TVYDSWFDPWGQGTLVTVSSASTKGP<br>SVFPLAPCSRSTSESTAALGCLVKDYFP<br>EPVTVSWNSGALTSGVHTFPAVLQSSG<br>LYSLSSVVTVPSSSLGTKTYTCNVDHK<br>PSNTKVDKRVESKYGPPCPPCPAPEFL<br>GGPSVFLFPPKPKDTLMISRTPEVTCVV<br>VDVSQEDPEVQFNWYVDGVEVHNAK<br>TKPREEQFNSTYRVVSVLTVLHQDWL<br>NGKEYKCKVSNKGLPSSIEKTISKAKG<br>QPREPQVYTLPPSQEEMTKNQVSLTCL<br>VKGFYPSDIAVEWESNGQPENNYKTTP<br>PVLDSDGSFFLYSRLTVDKSRWQEGN<br>VFSCSVMHEALHNHYTQKSLSLSLGK | SEQ ID 2120 | GAGGTGCAGCTGGTGCAGTCTGGGG<br>CTGAGGTGAAGAAGCCTGGGGCCTC<br>AGTGAAGGTTTCCTGCAAGGCTTCT<br>GGATACACCTTCACTAGCTATGCTA<br>TGCATTGGGTGCGCCAGGCCCCCGG<br>ACAAAGGCTTGAGTGGATGGGATG<br>GATCAACGCTGGCAATGGTAACACA<br>AAATATTCACAGAAGTTCCAGGGCA<br>GAGTCACCATTACCAGGGACACATC<br>CGCGAGCACAGCCTACATGGAGCTG<br>AGCAGCCTGAGATCTGAAGACACG<br>GCTGTGTATTACTGTGCGAGAGTTA<br>GAGTGGGAGCTACTACTGTTTACGA<br>CAGCTGGTTCGACCCCTGGGGCCAG<br>GGAACCCTGGTGACCGTCTCCTCAG<br>CATCCACCAAGGGGCCTTCCGTGTT<br>CCCCCTGGCCCCTTGCTCCCGCTCG<br>ACCTCTGAATCCACCGCCGCACTCG<br>GTTGCCTGGTCAAAGACTACTTCCC<br>CGAGCCCGTGACTGTCTCGTGGAAC<br>TCGGGCGCCCTCACATCCGGAGTGC<br>ATACCTTTCCCGCCGTGTTGCAGTCC<br>AGCGGCCTGTACAGCCTGAGCTCCG<br>TCGTGACAGTGCCGTCCTCCTCCCTT<br>GGAACCAAGACCTATACCTGCAACG<br>TCGACCACAAGCCCTCCAACACCAA<br>AGTGGACAAGCGCGTCGAATCCAA<br>GTACGGCCCCCCTTGTCCGCCTTGTC<br>CAGCCCCTGAGTTCCTGGGTGGTCC<br>GTCCGTGTTCCTCTTCCCGCCCAAGC<br>CGAAGGACACTCTGATGATTTCACG<br>CACCCCGGAAGTCACTTGCGTGGTC<br>GTGGACGTGTCGCAGGAAGATCCCG<br>AAGTGCAGTTCAATTGGTACGTGGA<br>TGGGGTCGAAGTGCACAACGCCAA<br>GACCAAGCCTAGGGAAGAACAGTT<br>CAACTCTACGTACCGGGTGGTGTCC<br>GTGCTGACCGTGCTGCACCAGGACT<br>GGCTGAACGGAAAGGAGTACAAGT<br>GCAAAGTGTCAAACAAGGGCCTCCC<br>TTCATCCATCGAAAAGACCATCAGC<br>AAGGCCAAGGGTCAACCTAGGGAG<br>CCCCAGGTCTACACTTTGCCGCCTA |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | GCCAAGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCCGGCTGACT GTGGACAAGTCAAGATGGCAGGAG GGAAACGTGTTCTCCTGCTCCGTGA TGCACGAAGCGCTGCACAACCATTA CACCCAGAAATCACTGTCACTTTCG CTGGGAAAA |
| SEQ ID 2013 | QVQLVQSGGGLVQPGGSLRLSCAASG FTFSSYAMSWVRQAPGKGLEWVSAIS GSGGSTYYADSVKGRFTISRDNSKNTL YLQMNSLRAEDTAVYYCAKDGGSSPY YDSSGLLPWYFDLWGRGTLVTVSSAS TKGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2121 | CAGGTGCAGCTGGTGCAGTCTGGGG GAGGCTTGGTACAGCCTGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGATGG GGGGTCCAGCCCATACTATGATAGT AGTGGTTTACTACCCTGGTACTTCG ATCTCTGGGGCCGTGGCACCCTGGT CACCGTCTCCTCAGCATCCACCAAG GGGCCTTCCGTGTTCCCCCTGGCCC CTTGCTCCCGCTCGACCTCTGAATCC ACCGCCGCACTCGGTTGCCTGGTCA AGGACTACTTCCCCGAGCCCGTGAC TGTCTCGTGGAACTCGGGCGCCCTC ACATCCGGAGTGCATACCTTTCCCG CCGTGTTGCAGTCCAGCGGCCTGTA CAGCCTGAGCTCCGTCGTGACAGTG CCGTCCTCCTCCCTTGGAACCAAGA CCTATACCTGCAACGTCGACCACAA GCCCTCCAACACCAAAGTGGACAAG CGCGTCGAATCCAAGTACGGCCCCC CTTGTCCGCCTTGTCCAGCCCCTGA GTTCCTGGGTGGTCCGTCCGTGTTCC TCTTCCCGCCCAAGCCGAAGGACAC TCTGATGATTTCACGCACCCCGGAA GTCACTTGCGTGGTCGTGGACGTGT CGCAGGAAGATCCCGAAGTGCAGTT CAATTGGTACGTGGATGGGGTCGAA GTGCACAACGCCAAGACCAAGCCTA GGGAAGAACAGTTCAACTCTACGTA CCGGGTGGTGTCCGTGCTGACCGTG CTGCACCAGGACTGGCTGAACGGAA AGGAGTACAAGTGCAAAGTGTCAA ACAAGGGCCTCCCTTCATCCATCGA AAAGACCATCAGCAAGGCCAAGGG TCAACCTAGGGAGCCCCAGGTCTAC ACTTTGCCGCCTAGCCAAGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CCGGCTGACTGTGGACAAGTCAAGA TGGCAGGAGGGAAACGTGTTCTCCT GCTCCGTGATGCACGAAGCGCTGCA CAACCATTACACCCAGAAATCACTG TCACTTTCGCTGGGAAAA |
| SEQ ID 2014 | QVQLQESGGGLVQPGGSLRLSCAASG FTFSSYAMHWVRQAPGKGLEYVSAISS NGGSTYYANSVKGRFTISRDNSKNTLY LQMGSLRAEDMAVYYCARAKFWTYY FDYWGQGTLVTVSSASTKGPSVFPLAP CSRSTSESTAALGCLVKDYFPEPVTVS | SEQ ID 2122 | CAGGTGCAGCTGCAGGAGTCGGGG GGAGGCTTGGTCCAGCCTGGGGGGT CCCTGAGACTCTCCTGTGCAGCCTC TGGATTCACCTTCAGTAGCTATGCT ATGCACTGGGTCCGCCAGGCTCCAG GGAAGGGACTGGAATATGTTTCAGC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | | TATTAGTAGTAATGGGGGTAGCACA TATTATGCAAACTCTGTGAAGGGCA GATTCACCATCTCCAGAGACAATTC CAAGAACACGCTGTATCTTCAAATG GGCAGCCTGAGAGCTGAGGACATG GCTGTGTATTACTGTGCGAGAGCTA AGTTTTGGACATACTACTTTGACTA CTGGGGCCAGGGAACCCTGGTGACC GTCTCCTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCAAGACCTA TACCTGCAACGTCGACCACAAGCCC TCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 2015 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGGGSGSYYKR FFDYWGQGTLVTVSSASTKGPSVFPLA PCSRSTSESTAALGCLVKDYFPEPVTVS WNSGALTSGVHTFPAVLQSSGLYSLSS VVTVPSSSLGTKTYTCNVDHKPSNTKV DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | SEQ ID 2123 | CAGGTGCAGCTACAGCAGTGGGGC GCAGGACTGTTGAAGCCTTCGGAGA CCCTGTCCCTCACCTGCGCTGTCTAT GGTTCGTTCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGGCGGTGG TTCGGGGAGTTATTATAAGAGGTTC TTTGACTACTGGGGCCAGGGAACCC TGGTCACCGTCTCCTCAGCATCCAC CAAGGGGCCTTCCGTGTTCCCCCTG GCCCCTTGCTCCCGCTCGACCTCTG AATCCACCGCCGCACTCGGTTGCCT GGTCAAAGACTACTTCCCCGAGCCC GTGACTGTCTCGTGGAACTCGGGCG CCCTCACATCCGGAGTGCATACCTT TCCCGCCGTGTTGCAGTCCAGCGGC CTGTACAGCCTGAGCTCCGTCGTGA CAGTGCCGTCCTCCTCCCTTGGAAC CAAGACCTATACCTGCAACGTCGAC CACAAGCCCTCCAACACCAAAGTGG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | ACAAGCGCGTCGAATCCAAGTACGG CCCCCCTTGTCCGCCTTGTCCAGCCC CTGAGTTCCTGGGTGGTCCGTCCGT GTTCCTCTTCCCGCCCAAGCCGAAG GACACTCTGATGATTTCACGCACCC CGGAAGTCACTTGCGTGGTCGTGGA CGTGTCGCAGGAAGATCCCGAAGTG CAGTTCAATTGGTACGTGGATGGGG TCGAAGTGCACAACGCCAAGACCA AGCCTAGGGAAGAACAGTTCAACTC TACGTACCGGGTGGTGTCCGTGCTG ACCGTGCTGCACCAGGACTGGCTGA ACGGAAAGGAGTACAAGTGCAAAG TGTCAAACAAGGGCCTCCCTTCATC CATCGAAAAGACCATCAGCAAGGC CAAGGGTCAACCTAGGGAGCCCCA GGTCTACACTTTGCCGCCTAGCCAA GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCCGGCTGACTGTGGACA AGTCAAGATGGCAGGAGGGAAACG TGTTCTCCTGCTCCGTGATGCACGA AGCGCTGCACAACCATTACACCCAG AAATCACTGTCACTTTCGCTGGGAA AA |
| SEQ ID 2016 | EVQLVQSGAEVRKPGASVKVSCKASG YTFTSYAISWVRQAPGQGLEWMGWIS AYDGNTNYAQKLQGRVTMTTDTSTST AYMEVRSLRSDDTAVYYCARDGTVR RVVGATTPGNFDYRGQGTLVTVSSAS TKGPSVFPLAPCSRSTSESTAALGCLVK DYFPEPVTVSWNSGALTSGVHTFPAVL QSSGLYSLSSVVTVPSSSLGTKTYTCN VDHKPSNTKVDKRVESKYGPPCPPCPA PEFLGGPSVFLFPPKPKDTLMISRTPEV TCVVVDVSQEDPEVQFNWYVDGVEV HNAKTKPREEQFNSTYRVVSVLTVLH QDWLNGKEYKCKVSNKGLPSSIEKTIS KAKGQPREPQVYTLPPSQEEMTKNQV SLTCLVKGFYPSDIAVEWESNGQPENN YKTTPPVLDSDGSFFLYSRLTVDKSRW QEGNVFSCSVMHEALHNHYTQKSLSL SLGK | SEQ ID 2124 | GAGGTGCAGCTGGTGCAGTCTGGAG CTGAGGTGAGGAAGCCTGGGGCCTC AGTGAAGGTCTCCTGCAAGGCTTCT GGTTACACATTTACCAGTTATGCCA TCAGCTGGGTGCGACAGGCCCCTGG ACAAGGGCTTGAGTGGATGGGGTG GATCAGCGCTTACGACGGTAACACA AACTATGCACAGAAGCTCCAGGGCA GAGTCACCATGACCACAGACACATC CACGAGCACAGCCTACATGGAGGTG AGGAGCCTGAGATCTGACGACACG GCCGTGTATTACTGTGCGAGAGATG GTACGGTCCGAAGGGTAGTGGGAG CTACTACCCCTGGAAACTTTGACTA CAGGGGCCAGGGAACCCTGGTCACC GTCTCCTCAGCATCCACCAAGGGGC CTTCCGTGTTCCCCCTGGCCCCTTGC TCCCGCTCGACCTCTGAATCCACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCAAGACCTA TACCTGCAACGTCGACCACAAGCCC TCCAACACCAAAGTGGACAAGCGC GTCGAATCCAAGTACGGCCCCCCTT GTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT |

TABLE 39-continued

Anti-CLEC21D IgG4 antibody Variable Heavy and Light Chain
amino acid and DNA sequence

| SEQ ID | VH + CH + AA_IgG4 | SEQ ID | VH + CH + DNA_IgG4 |
|---|---|---|---|
| | | | TGCCTTGTCAAGGGCTTTTATCCGTC
CGACATCGCCGTGGAGTGGGAGTCC
AACGGACAACCGGAGAACAACTAC
AAGACCACCCCACCGGTGCTCGATT
CCGATGGCTCCTTCTTCCTGTACTCC
CGGCTGACTGTGGACAAGTCAAGAT
GGCAGGAGGGAAACGTGTTCTCCTG
CTCCGTGATGCACGAAGCGCTGCAC
AACCATTACACCCAGAAATCACTGT
CACTTTCGCTGGGAAAA |
| SEQ ID 2017 | EVQLVQSGGGVVQPGRSLRLSCAASG
FTFSSYGMHWVRQAPGKGLEWVAVI
WYDGSNKYYADSVKGRFTISRDNSKN
TLYLQMNSLRAEDTAVYYCARDLNRG
YCSGGSCFGYWGQGTLVTVSSASTKG
PSVFPLAPCSRSTSESTAALGCLVKDYF
PEPVTVSWNSGALTSGVHTFPAVLQSS
GLYSLSSVVTVPSSSLGTKTYTCNVDH
KPSNTKVDKRVESKYGPPCPPCPAPEF
LGGPSVFLFPPKPKDTLMISRTPEVTCV
VVDVSQEDPEVQFNWYVDGVEVHNA
KTKPREEQFNSTYRVVSVLTVLHQDW
LNGKEYKCKVSNKGLPSSIEKTISKAK
GQPREPQVYTLPPSQEEMTKNQVSLTC
LVKGFYPSDIAVEWESNGQPENNYKT
TPPVLDSDGSFFLYSRLTVDKSRWQEG
NVFSCSVMHEALHNHYTQKSLSLSLG
K | SEQ ID 2125 | GAGGTGCAGCTGGTGCAGTCTGGGG
GAGGCGTGGTCCAGCCTGGGAGGTC
CCTGAGACTCTCCTGTGCAGCGTCT
GGATTCACCTTCAGTAGCTATGGCA
TGCACTGGGTCCGCCAGGCTCCAGG
CAAGGGGCTGGAGTGGGTGGCAGTT
ATATGGTATGATGGAAGTAATAAAT
ACTATGCAGACTCCGTGAAGGGCCG
ATTCACCATCTCCAGAGACAATTCC
AAGAACACGCTGTATCTGCAAATGA
ACAGCCTGAGAGCCGAGGACACGG
CTGTGTATTACTGTGCGAGAGATCT
GAATCGAGGATATTGTAGTGGTGGT
AGCTGCTTTGGCTACTGGGGCCAGG
GAACCCTGGTCACCGTCTCCTCAGC
ATCCACCAAGGGCCCTTCCGTGTTC
CCCCTGGCCCCTTGCTCCCGCTCGA
CCTCTGAATCCACCGCCGCACTCGG
TTGCCTGGTCAAAGACTACTTCCCC
GAGCCCGTGACTGTCTCGTGGAACT
CGGGCGCCCTCACATCCGGAGTGCA
TACCTTTCCCGCCGTGTTGCAGTCCA
GCGGCCTGTACAGCCTGAGCTCCGT
CGTGACAGTGCCGTCCTCCTCCCTT
GGAACCAAGACCTATACCTGCAACG
TCGACCACAAGCCCTCCAACACCAA
AGTGGACAAGCGCGTCGAATCCAA
GTACGGCCCCCCCTTGTCCGCCTTGTC
CAGCCCCTGAGTTCCTGGGTGGTCC
GTCCGTGTTCCTCTTCCCGCCCAAGC
CGAAGGACACTCTGATGATTTCACG
CACCCCGGAAGTCACTTGCGTGGTC
GTGGACGTGTCGCAGGAAGATCCCG
AAGTGCAGTTCAATTGGTACGTGGA
TGGGGTCGAAGTGCACAACGCCAA
GACCAAGCCTAGGGAAGAACAGTT
CAACTCTACGTACCGGGTGGTGTCC
GTGCTGACCGTGCTGCACCAGGACT
GGCTGAACGGAAAGGAGTACAAGT
GCAAAGTGTCAAACAAGGGCCTCC
TTCATCCATCGAAAAGACCATCAGC
AAGGCCAAGGGTCAACCTAGGGAG
CCCCAGGTCTACACTTTGCCGCCTA
GCCAAGAAGAAATGACTAAGAACC
AAGTGTCCCTGACTTGCCTTGTCAA
GGGCTTTTATCCGTCCGACATCGCC
GTGGAGTGGGAGTCCAACGGACAA
CCGGAGAACAACTACAAGACCACC
CCACCGGTGCTCGATTCCGATGGCT
CCTTCTTCCTGTACTCCCGGCTGACT
GTGGACAAGTCAAGATGGCAGGAG
GGAAACGTGTTCTCCTGCTCCGTGA
TGCACGAAGCGCTGCACAACCATTA
CACCCAGAAATCACTGTCACTTTCG
CTGGGAAAA |
| SEQ ID 2018 | QVQLQESGGGLVQPGGSLRLSCAASG
FTFSSYAMSWVRQAPGKGLEWVSYIS
SSGTTIYYADSVKGRFTVSRDNAKNSL
YLQMNSLRAEDTAVYYCARDYSSSGE
CFDYWGQGTLVTVSSASTKGPSVFPLA
PCSRSTSESTAALGCLVKDYFPEPVTVS
WNSGALTSGVHTFPAVLQSSGLYSLSS
VVTVPSSSLGTKTYTCNVDHKPSNTKV | SEQ ID 2126 | CAGGTGCAGCTGCAGGAGTCTGGGG
GAGGCTTGGTACAGCCGGGGGGGTC
CCTGAGACTCTCCTGTGCAGCCTCT
GGATTCACCTTTAGCAGCTATGCCA
TGAGCTGGGTCCGCCAGGCTCCAGG
GAAGGGGCTGGAGTGGGTTTCATAC
ATTAGTAGTAGTGGTACTACCATAT
ACTACGCAGACTCTGTGAAGGGCCG |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | DKRVESKYGPPCPPCPAPEFLGGPSVFL FPPKPKDTLMISRTPEVTCVVVDVSQE DPEVQFNWYVDGVEVHNAKTKPREE QFNSTYRVVSVLTVLHQDWLNGKEYK CKVSNKGLPSSIEKTISKAKGQPREPQV YTLPPSQEEMTKNQVSLTCLVKGFYPS DIAVEWESNGQPENNYKTTPPVLDSD GSFFLYSRLTVDKSRWQEGNVFSCSV MHEALHNHYTQKSLSLSLGK | | ATTCACCGTCTCCAGAGACAATGCC AAGAACTCACTGTATCTGCAAATGA ACAGCCTGAGAGCCGAGGACACGG CCGTGTATTACTGTGCGAGGGATTA TAGCAGCTCGGGGGAGTGCTTTGAC TACTGGGGCCAGGGAACCCTGGTCA CCGTCTCCTCAGCATCCACCAAGGG GCCTTCCGTGTTCCCCCTGGCCCCTT GCTCCCGCTCGACCTCTGAATCCAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCCGCC GTGTTGCAGTCCAGCGGCCTGTACA GCCTGAGCTCCGTCGTGACAGTGCC GTCCTCCTCCCTTGGAACCAAGACC TATACCTGCAACGTCGACCACAAGC CCTCCAACACCAAAGTGGACAAGCG CGTCGAATCCAAGTACGGCCCCCCT TGTCCGCCTTGTCCAGCCCCTGAGTT CCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC AGGAAGATCCCGAAGTGCAGTTCAA TTGGTACGTGGATGGGGTCGAAGTG CACAACGCCAAGACCAAGCCTAGG GAAGAACAGTTCAACTCTACGTACC GGGTGGTGTCCGTGCTGACCGTGCT GCACCAGGACTGGCTGAACGGAAA GGAGTACAAGTGCAAAGTGTCAAA CAAGGGCCTCCCTTCATCCATCGAA AAGACCATCAGCAAGGCCAAGGGT CAACCTAGGGAGCCCCAGGTCTACA CTTTGCCGCCTAGCCAAGAAGAAAT GACTAAGAACCAAGTGTCCCTGACT TGCCTTGTCAAGGGCTTTTATCCGTC CGACATCGCCGTGGAGTGGGAGTCC AACGGACAACCGGAGAACAACTAC AAGACCACCCCACCGGTGCTCGATT CCGATGGCTCCTTCTTCCTGTACTCC CGGCTGACTGTGGACAAGTCAAGAT GGCAGGAGGGAAACGTGTTCTCCTG CTCCGTGATGCACGAAGCGCTGCAC AACCATTACACCCAGAAATCACTGT CACTTTCGCTGGGAAAA |
| SEQ ID 2019 | EVQLVQSGGGVVQPGRSLRLSCAASG FTFSSYGMHWVRQAPGKGLEWVAVI WYDGSNKYYADSVKGRFTISRDNSKN TLYLQMNSLRAEDTAVYYCARDQAA MVGYFDYWGQGTLVTVSSASTKGPSV FPLAPCSRSTSESTAALGCLVKDYFPEP VTVSWNSGALTSGVHTFPAVLQSSGL YSLSSVVTVPSSSLGTKTYTCNVDHKP SNTKVDKRVESKYGPPCPPCPAPEFLG GPSVFLFPPKPKDTLMISRTPEVTCVVV DVSQEDPEVQFNWYVDGVEVHNAKT KPREEQFNSTYRVVSVLTVLHQDWLN GKEYKCKVSNKGLPSSIEKTISKAKGQ PREPQVYTLPPSQEEMTKNQVSLTCLV KGFYPSDIAVEWESNGQPENNYKTTPP VLDSDGSFFLYSRLTVDKSRWQEGNV FSCSVMHEALHNHYTQKSLSLSLGK | SEQ ID 2127 | GAGGTGCAGCTGGTGCAGTCTGGGG GAGGCGTGGTCCAGCCTGGGAGGTC CCTGAGACTCTCCTGTGCAGCGTCT GGATTCACCTTCAGTAGCTATGGCA TGCACTGGGTCCGCCAGGCTCCAGG CAAGGGCTGGAGTGGGTGGCAGTT ATATGGTATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCCGAGGACACGG CTGTGTATTACTGTGCGAGAGATCA GGCAGCTATGGTAGGCTACTTTGAC TACTGGGGCCAGGGAACCCTGGTCA CCGTCTCCTCAGCATCCACCAAGGG GCCTTCCGTGTTCCCCCTGGCCCCTT GCTCCCGCTCGACCTCTGAATCCAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCCGCC GTGTTGCAGTCCAGCGGCCTGTACA GCCTGAGCTCCGTCGTGACAGTGCC GTCCTCCTCCCTTGGAACCAAGACC TATACCTGCAACGTCGACCACAAGC CCTCCAACACCAAAGTGGACAAGCG CGTCGAATCCAAGTACGGCCCCCCT TGTCCGCCTTGTCCAGCCCCTGAGTT |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CCTGGGTGGTCCGTCCGTGTTCCTCT<br>TCCCGCCCAAGCCGAAGGACACTCT<br>GATGATTTCACGCACCCCGGAAGTC<br>ACTTGCGTGGTCGTGGACGTGTCGC<br>AGGAAGATCCCGAAGTGCAGTTCAA<br>TTGGTACGTGGATGGGGTCGAAGTG<br>CACAACGCCAAGACCAAGCCTAGG<br>GAAGAACAGTTCAACTCTACGTACC<br>GGGTGGTGTCCGTGCTGACCGTGCT<br>GCACCAGGACTGGCTGAACGGAAA<br>GGAGTACAAGTGCAAAGTGTCAAA<br>CAAGGGCCTCCCTTCATCCATCGAA<br>AAGACCATCAGCAAGGCCAAGGGT<br>CAACCTAGGGAGCCCCAGGTCTACA<br>CTTTGCCGCCTAGCCAAGAAGAAAT<br>GACTAAGAACCAAGTGTCCCTGACT<br>TGCCTTGTCAAGGGCTTTTATCCGTC<br>CGACATCGCCGTGGAGTGGGAGTCC<br>AACGGACAACCGGAGAACAACTAC<br>AAGACCACCCCACCGGTGCTCGATT<br>CCGATGGCTCCTTCTTCCTGTACTCC<br>CGGCTGACTGTGGACAAGTCAAGAT<br>GGCAGGAGGGAAACGTGTTCTCCTG<br>CTCCGTGATGCACGAAGCGCTGCAC<br>AACCATTACACCCAGAAATCACTGT<br>CACTTTCGCTGGGAAAA |
| SEQ ID<br>2020 | QVTLKESGGGVVQPGRSLRLSCAASGF<br>IFSNYAIHWVRQAPGKGLEWVAVISY<br>DGSNKYYADSVKGRFTISRDNSKNTL<br>YLQMNSLRAEDTAVYYCARTFAGYSS<br>KLGYFDLWGRGTLVTVSSASTKGPSV<br>FPLAPCSRSTSESTAALGCLVKDYFPEP<br>VTVSWNSGALTSGVHTFPAVLQSSGL<br>YSLSSVVTVPSSSLGTKTYTCNVDHKP<br>SNTKVDKRVESKYGPPCPPCPAPEFLG<br>GPSVFLFPPKPKDTLMISRTPEVTCVVV<br>DVSQEDPEVQFNWYVDGVEVHNAKT<br>KPREEQFNSTYRVVSVLTVLHQDWLN<br>GKEYKCKVSNKGLPSSIEKTISKAKGQ<br>PREPQVYTLPPSQEEMTKNQVSLTCLV<br>KGFYPSDIAVEWESNGQPENNYKTTPP<br>VLDSDGSFFLYSRLTVDKSRWQEGNV<br>FSCSVMHEALHNHYTQKSLSLSLGK | SEQ ID<br>2128 | CAGGTCACCTTGAAGGAGTCTGGGG<br>GAGGCGTGGTCCAGCCTGGGAGGTC<br>CCTGAGACTCTCCTGTGCAGCCTCT<br>GGATTCATCTTCAGTAACTATGCTA<br>TACACTGGGTCCGCCAGGCTCCAGG<br>CAAGGGCTGGAGTGGGTGGCAGTT<br>ATATCATATGATGGAAGTAATAAAT<br>ACTACGCAGACTCCGTGAAGGGCCG<br>ATTCACCATCTCCAGAGACAATTCC<br>AAGAACACGCTGTATCTGCAAATGA<br>ACAGCCTGAGAGCTGAGGACACGG<br>CTGTGTATTACTGTGCGAGGACTTTT<br>GCGGGGTATAGCAGCAAACTGGGG<br>TACTTCGATCTCTGGGGCCGTGGCA<br>CCCTGGTCACCGTCTCCTCAGCATC<br>CACCAAGGGGCCTTCCGTGTTCCCC<br>CTGGCCCCTTGCTCCCGCTCGACCTC<br>TGAATCCACCGCCGCACTCGGTTGC<br>CTGGTCAAAGACTACTTCCCCGAGC<br>CCGTGACTGTCTCGTGGAACTCGGG<br>CGCCCTCACATCCGGAGTGCATACC<br>TTTCCCGCCGTGTTGCAGTCCAGCG<br>GCCTGTACAGCCTGAGCTCCGTCGT<br>GACAGTGCCGTCCTCCTCCCTTGGA<br>ACCAAGACCTATACCTGCAACGTCG<br>ACCACAAGCCCTCCAACACCAAAGT<br>GGACAAGCGCGTCGAATCCAAGTAC<br>GGCCCCCCTTGTCCGCCTTGTCCAG<br>CCCCTGAGTTCCTGGGTGGTCCGTC<br>CGTGTTCCTCTTCCCGCCCAAGCCG<br>AAGGACACTCTGATGATTTCACGCA<br>CCCCGGAAGTCACTTGCGTGGTCGT<br>GGACGTGTCGCAGGAAGATCCCGA<br>AGTGCAGTTCAATTGGTACGTGGAT<br>GGGGTCGAAGTGCACAACGCCAAG<br>ACCAAGCCTAGGGAAGAACAGTTC<br>AACTCTACGTACCGGGTGGTGTCCG<br>TGCTGACCGTGCTGCACCAGGACTG<br>GCTGAACGGAAAGGAGTACAAGTG<br>CAAAGTGTCAAACAAGGGCCTCCCT<br>TCATCCATCGAAAAGACCATCAGCA<br>AGGCCAAGGGTCAACCTAGGGAGC<br>CCCAGGTCTACACTTTGCCGCCTAG<br>CCAAGAAGAAATGACTAAGAACCA<br>AGTGTCCCTGACTTGCCTTGTCAAG<br>GGCTTTTATCCGTCCGACATCGCCG<br>TGGAGTGGGAGTCCAACGGACAAC<br>CGGAGAACAACTACAAGACCACCC |

TABLE 39-continued

Anti-CLEC21D IgG4 antibody Variable Heavy and Light Chain amino acid and DNA sequence

| SEQ ID | VH + CH + AA_IgG4 | SEQ ID | VH + CH + DNA_IgG4 |
|---|---|---|---|
| | | | CACCGGTGCTCGATTCCGATGGCTC CTTCTTCCTGTACTCCCGGCTGACTG TGGACAAGTCAAGATGGCAGGAGG GAAACGTGTTCTCCTGCTCCGTGAT GCACGAAGCGCTGCACAACCATTAC ACCCAGAAATCACTGTCACTTTCGC TGGGAAAA |

TABLE 40

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| SEQ ID 2129 | EVQLVQSGAEVKKPGASVKVSCKASG YTFTSYAMHWVRQAPGQRLEWMGWI NAGNGNTKYSQKFQGRVTITRDTSAST AYMELSSLRSEDTAVYYCARGSLSRSG WYAGLFDYWGQGTLVTVSSASTKGPS VFPLAPSSKSTSGGTAALGCLVKDYFP EPVTVSWNSGALTSGVHTFPAVLQSSG LYSLSSVVTVPSSSLGTQTYICNVNHKP SNTKVDKKVEPKSCDKTHTCPPCPAPE LLGGPSVFLFPPKPKDTLMISRTPEVTC VVVDVSHEDPEVKFNWYVDGVEVHN AKTKPREEQYASTYRVVSVLTVLHQD WLNGKEYKCKVSNKALPAPIEKTISKA KGQPREPQVYTLPPSREEMTKNQVSLT CLVKGFYPSDIAVEWESNGQPENNYK TTPPVLDSDGSFFLYSKLTVDKSRWQQ GNVFSCSVMHEALHNHYTQKSLSLSP GK | SEQ ID 2237 | GAAGTGCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATTACCAGGGACACATC CGCCAGCACAGCCTACATGGAGCTG AGCAGCCTGAGATCTGAAGACACG GCTGTGTATTACTGTGCGAGAGGCT CCTTGTCCCGAAGTGGCTGGTACGC CGGACTCTTTGACTACTGGGGCCAG GGAACCCTGGTCACCGTCTCCTCAG CATCCACCAAGGGGCCTTCCGTGTT CCCCCTGGCCCCTTCATCCAAGTCG ACCTCTGGTGAACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| SEQ ID 2130 | QITLKESGGGVVQPGRSLRLSCAASGF TFSSYSMNWVRQAPGKGLQWVAIISD DGSKSYYADSVQGRFTISRDNSRNTVF LQMNSLRAEDTAMYYCARDRGTKWN QLNDVFDMWGQGTMVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2238 | CAGATCACCTTGAAGGAGTCTGGGG GAGGCGTGGTCCAGCCTGGGAGGTC CCTGAGACTCTCCTGTGCAGCCTCT GGATTCACCTTCAGTAGTTATAGCA TGAACTGGGTCCGCCAGGCTCCAGG CAAGGGGCTGCAGTGGGTGGCAATT ATATCAGATGATGGAAGTAAGAGTT ACTACGCAGACTCCGTGCAGGGCCG ATTCACCATCTCCAGAGACAATTCG AGGAACACAGTATTTCTGCAAATGA ACAGCCTGAGAGCTGAGGACACGG CTATGTATTACTGTGCGAGAGACAG GGGAACTAAATGGAACCAATTGAAT GATGTTTTTGATATGTGGGGCCAAG GGACAATGGTCACCGTCTCTTCAGC ATCCACCAAGGGGCCTTCCGTGTTC CCCCTGGCCCCTTCATCCAAGTCGA CCTCTGGTGGAACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2131 | EVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCARGRGYSSS RLYYFDYWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2239 | GAAGTGCAGCTGGTGCAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGAGGCC GAGGGTATAGCAGCAGTCGGCTCTA CTACTTTGACTACTGGGGCCAGGGA ACCCTGGTCACCGTCTCCTCAGCAT CCACCAAGGGGCCTTCCGTGTTCCC CCTGGCCCCTTCATCCAAGTCGACC TCTGGTGGAACCGCCGCACTCGGTT GCCTGGTCAAAGACTACTTCCCCGA GCCCGTGACTGTCTCGTGGAACTCG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GGCGCCCTCACATCCGGAGTGCATA |
| | | | CCTTTCCCGCCGTGTTGCAGTCCAG |
| | | | CGGCCTGTACAGCCTGAGCTCCGTC |
| | | | GTGACAGTGCCGTCCTCCTCCCTTG |
| | | | GAACCCAGACCTATATCTGCAACGT |
| | | | CAATCACAAGCCCTCCAACACCAAA |
| | | | GTGGACAAGAAGGTCGAACCCAAG |
| | | | TCCTGCGACAAGACTCACACCTGTC |
| | | | CGCCTTGTCCAGCCCCTGAGCTGCT |
| | | | GGGTGGTCCGTCCGTGTTCCTCTTCC |
| | | | CGCCCAAGCCGAAGGACACTCTGAT |
| | | | GATTTCACGCACCCCGGAAGTCACT |
| | | | TGCGTGGTCGTGGACGTGTCGCACG |
| | | | AAGATCCCGAAGTGAAATTCAATTG |
| | | | GTACGTGGATGGGGTCGAAGTGCAC |
| | | | AACGCCAAGACCAAGCCTAGGGAA |
| | | | GAACAGTACgccTCTACGTACCGGGT |
| | | | GGTGTCCGTGCTGACCGTGCTGCAC |
| | | | CAGGACTGGCTGAACGGAAAGGAG |
| | | | TACAAGTGCAAAGTGTCAAACAAG |
| | | | GCTCTCCCTGCCCCTATCGAAAAGA |
| | | | CCATCAGCAAGGCCAAGGGTCAACC |
| | | | TAGGGAGCCCCAGGTCTACACTTTG |
| | | | CCGCCTAGCCGGGAAGAAATGACTA |
| | | | AGAACCAAGTGTCCCTGACTTGCCT |
| | | | TGTCAAGGGCTTTTATCCGTCCGAC |
| | | | ATCGCCGTGGAGTGGGAGTCCAACG |
| | | | GACAACCGGAGAACAACTACAAGA |
| | | | CCACCCCACCGGTGCTCGATTCCGA |
| | | | TGGCTCCTTCTTCCTGTACTCCAAGC |
| | | | TGACTGTGGACAAGTCAAGATGGCA |
| | | | GCAGGGAAACGTGTTCTCCTGCTCC |
| | | | GTGATGCACGAAGCGCTGCACAACC |
| | | | ATTACACCCAGAAATCACTGTCACT |
| | | | TTCGCCGGGAAAA |
| SEQ ID 2132 | QVTLKESGGGLVRPGGSLRLSCEASGF TFSDPYMDWVRQAPGKGLEWVGRITN KRTGYATTYAASVKDRFTISRDDSRKS VYLQMNSLKTEDTAVYYCATDVSGSF AAYGGQGTLVTVSSASTKGPSVFPLAP SSKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2240 | CAGGTCACCTTGAAGGAGTCTGGGG GAGGCTTGGTCCGGCCTGGAGGGTC CCTGAGACTCTCCTGTGAAGCCTCT GGATTCACCTTCAGTGACCCCTACA TGGACTGGGTCCGCCAGGCTCCAGG CAAGGGGCTGGAGTGGGTTGGCGG AATTACAAATAAGCGTACCGGTTAC GCCACAACATATGCCGCGTCTGTGA AGGACAGATTCACCATCTCAAGAGA TGATTCAAGGAAGTCAGTATATCTG CAAATGAACAGCCTGAAGACCGAG GACACGGCCGTATATTATTGTGCAA CAGATGTCAGTGGGTCCTTCGCGGC CTACGGGGGCCAGGGCACCCTGGTC ACCGTCTCCTCAGCATCCACCAAGG GGCCTTCCGTGTTCCCCCTGGCCCCT TCATCCAAGTCGACCTCTGGTGGAA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCCAGAC CTATATCTGCAACGTCAATCACAAG CCCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCCTATCGAAAAGACCATCAGCAAG<br>GCCAAGGGTCAACCTAGGGAGCCCC<br>AGGTCTACACTTTGCCGCCTAGCCG<br>GGAAGAAATGACTAAGAACCAAGT<br>GTCCCTGACTTGCCTTGTCAAGGGC<br>TTTTATCCGTCCGACATCGCCGTGG<br>AGTGGGAGTCCAACGGACAACCGG<br>AGAACAACTACAAGACCACCCCACC<br>GGTGCTCGATTCCGATGGCTCCTTCT<br>TCCTGTACTCCAAGCTGACTGTGGA<br>CAAGTCAAGATGGCAGCAGGGAAA<br>CGTGTTCTCCTGCTCCGTGATGCAC<br>GAAGCGCTGCACAACCATTACACCC<br>AGAAATCACTGTCACTTTCGCCGGG<br>AAAA |
| SEQ ID 2133 | EVQLVQSGGGVVQPGRSLRLSCAASG<br>FTFSSYAMHWVRQAPGQRLEWMGWI<br>NAGNGNTKYSQKFQGRVTITRDTSAST<br>AYMELSSLRSEDTAVYYCAGEGGAVA<br>GTVYWGQGTLVTVSSASTKGPSVFPL<br>APSSKSTSGGTAALGCLVKDYFPEPVT<br>VSWNSGALTSGVHTFPAVLQSSGLYSL<br>SSVVTVPSSSLGTQTYICNVNHKPSNT<br>KVDKKVEPKSCDKTHTCPPCPAPELLG<br>GPSVFLFPPKPKDTLMISRTPEVTCVVV<br>DVSHEDPEVKFNWYVDGVEVHNAKT<br>KPREEQYASTYRVVSVLTVLHQDWLN<br>GKEYKCKVSNKALPAPIEKTISKAKGQ<br>PREPQVYTLPPSREEMTKNQVSLTCLV<br>KGFYPSDIAVEWESNGQPENNYKTTPP<br>VLDSDGSFFLYSKLTVDKSRWQQGNV<br>FSCSVMHEALHNHYTQKSLSLSPGK | SEQ ID 2241 | GAGGTCCAGCTGGTACAGTCTGGGG<br>GAGGCGTGGTCCAGCCTGGGAGGTC<br>CCTGAGACTCTCCTGTGCAGCGTCT<br>GGATTCACCTTCAGTAGCTATGCTA<br>TGCATTGGGTGCGCCAGGCCCCGG<br>ACAAAGGCTTGAGTGGATGGGATG<br>GATCAACGCTGGCAATGGTAACACA<br>AAATATTCACAGAAGTTCCAGGGCA<br>GAGTCACCATTACCAGGGACACATC<br>CGCGAGCACAGCCTACATGGAGCTG<br>AGCAGCCTGAGATCTGAAGACACG<br>GCTGTGTATTACTGTGCGGGAGAGG<br>GCGGAGCAGTGGCTGGTACTGTCTA<br>CTGGGGCCAGGGAACCCTGGTCACC<br>GTCTCCTCAGCATCCACCAAGGGGC<br>CTTCCGTGTTCCCCCTGGCCCCTTCA<br>TCCAAGTCGACCTCTGGTGGAACCG<br>CCGCACTCGGTTGCCTGGTCAAAGA<br>CTACTTCCCCGAGCCCGTGACTGTC<br>TCGTGGAACTCGGGCGCCCTCACAT<br>CCGGAGTGCATACCTTTCCCGCCGT<br>GTTGCAGTCCAGCGGCCTGTACAGC<br>CTGAGCTCCGTCGTGACAGTGCCGT<br>CCTCCTCCCTTGGAACCCAGACCTA<br>TATCTGCAACGTCAATCACAAGCCC<br>TCCAACACCAAAGTGGACAAGAAG<br>GTCGAACCCAAGTCCTGCGACAAGA<br>CTCACACCTGTCCGCCTTGTCCAGC<br>CCCTGAGCTGCTGGGTGGTCCGTCC<br>GTGTTCCTCTTCCCGCCCAAGCCGA<br>AGGACACTCTGATGATTTCACGCAC<br>CCCGGAAGTCACTTGCGTGGTCGTG<br>GACGTGTCGCACGAAGATCCCGAAG<br>TGAAATTCAATTGGTACGTGGATGG<br>GGTCGAAGTGCACAACGCCAAGAC<br>CAAGCCTAGGGAAGAACAGTACgcc<br>TCTACGTACCGGGTGGTGTCCGTGC<br>TGACCGTGCTGCACCAGGACTGGCT<br>GAACGGAAAGGAGTACAAGTGCAA<br>AGTGTCAAACAAGGCTCTCCCTGCC<br>CCTATCGAAAAGACCATCAGCAAGG<br>CCAAGGGTCAACCTAGGGAGCCCCA<br>GGTCTACACTTTGCCGCCTAGCCGG<br>GAAGAAATGACTAAGAACCAAGTG<br>TCCCTGACTTGCCTTGTCAAGGGCTT<br>TTATCCGTCCGACATCGCCGTGGAG<br>TGGGAGTCCAACGGACAACCGAG<br>AACAACTACAAGACCACCCCACCGG<br>TGCTCGATTCCGATGGCTCCTTCTTC<br>CTGTACTCCAAGCTGACTGTGGACA<br>GTCAAGATGGCAGCAGGGAAACG<br>TGTTCTCCTGCTCCGTGATGCACGA<br>AGCGCTGCACAACCATTACACCCAG<br>AAATCACTGTCACTTTCGCCGGGAA<br>AA |
| SEQ ID 2134 | QVQLVQSGGGLVKPGGSLRLSCAASG<br>FTFSNAWMSWVRQAPGKGLEWVGRI<br>KSKTDGGTTDYAAPVKGRFTISRDDSK<br>NTLYLQMNSLKTEDTAVYYCTTDEYF | SEQ ID 2242 | CAGGTCCAGCTGGTGCAGTCTGGGG<br>GAGGCTTGGTAAAGCCTGGGGGGTC<br>CCTTAGACTCTCCTGTGCAGCCTCTG<br>GATTCACTTTCAGTAACGCCTGGAT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | YWGQGTLVTVSSASTKGPSVFPLAPSS KSTSGGTAALGCLVKDYFPEPVTVSW NSGALTSGVHTFPAVLQSSGLYSLSSV VTVPSSSLGTQTYICNVNHKPSNTKVD KKVEPKSCDKTHTCPPCPAPELLGGPS VFLFPPKPKDTLMISRTPEVTCVVVDV SHEDPEVKFNWYVDGVEVHNAKTKP REEQYASTYRVVSVLTVLHQDWLNGK EYKCKVSNKALPAPIEKTISKAKGQPR EPQVYTLPPSREEMTKNQVSLTCLVKG FYPSDIAVEWESNGQPENNYKTTPPVL DSDGSFFLYSKLTVDKSRWQQGNVFS CSVMHEALHNHYTQKSLSLSPGK | | GAGCTGGGTCCGCCAGGCTCCAGGG AAGGGGCTGGAGTGGGTTGGCCGTA TTAAAAGCAAAACTGATGGTGGGAC AACAGACTACGCTGCACCCGTGAAA GGCAGATTCACCATCTCAAGAGATG ATTCAAAAAACACGCTGTATCTGCA AATGAACAGCCTGAAAACCGAGGA CACAGCCGTGTATTACTGTACCACA GACGAGTATTTCTACTGGGGCCAGG GAACCCTGGTCACCGTCTCCTCAGC ATCCACCAAGGGGCCTTCCGTGTTC CCCCTGGCCCCTTCATCCAAGTCGA CCTCTGGTGGAACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2135 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARVNPGSYTREV SNFDYWGQGTLVTVSSASTKGPSVFPPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2243 | CAGGTGCAGCTACAGCAGTGGGGC GCAGGACTGTTGAAGCCTTCGGAGA CCCTGTCCCTCACCTGCGCTGTCTAT GGTGGGTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGTAAATCC GGGGAGTTATACGAGGGAGGTGAG CAACTTTGACTACTGGGGCCAGGGA ACCCTGGTGACCGTCTCCTCAGCAT CCACCAAGGGGCCTTCCGTGTTCCC CCTGGCCCCTTCATCCAAGTCGACC TCTGGTGGAACCGCCGCACTCGGTT GCCTGGTCAAAGACTACTTCCCCGA GCCCGTGACTGTCTCGTGGAACTCG GGCGCCCTCACATCCGGAGTGCATA CCTTTCCCGCCGTGTTGCAGTCCAG CGGCCTGTACAGCCTGAGCTCCGTC GTGACAGTGCCGTCCTCCTCCCTTG GAACCCAGACCTATATCTGCAACGT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CAATCACAAGCCCTCCAACACCAAA GTGGACAAGAAGGTCGAACCCAAG TCCTGCGACAAGACTCACACCTGTC CGCCTTGTCCAGCCCCTGAGCTGCT GGGTGGTCCGTCGTGTTCCTCTTCC CGCCCAAGCCGAAGGACACTCTGAT GATTTCACGCACCCCGGAAGTCACT TGCGTGGTCGTGGACGTGTCGCACG AAGATCCCGAAGTGAAATTCAATTG GTACGTGGATGGGGTCGAAGTGCAC AACGCCAAGACCAAGCCTAGGGAA GAACAGTACgccTCTACGTACCGGGT GGTGTCCGTGCTGACCGTGCTGCAC CAGGACTGGCTGAACGGAAAGGAG TACAAGTGCAAAGTGTCAAACAAG GCTCTCCCTGCCCCTATCGAAAAGA CCATCAGCAAGGCCAAGGGTCAACC TAGGGAGCCCCAGGTCTACACTTTG CCGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2136 | QVQLQQSGPELVKPSQTLTLTCGISGD SVSSNSVTWNWVRQSPSRGLEWLGRT YYRSQWYNYAVSVKSRITISPDTSKN QFSLQLNSVTPEDTAVYYCATRGHNY GVDYWGPGTTVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2244 | CAGGTACAGCTGCAGCAGTCAGGTC CAGAATTGGTGAAGCCCTCGCAGAC CCTCACACTCACCTGTGGCATCTCC GGGGACAGTGTCTCTAGCAACAGTG TTACTTGGAACTGGGTCAGGCAGTC CCCATCGAGAGGCCTTGAGTGGCTG GGAAGGACTTACTACCGGTCCCAGT GGTATTATAATTATGCGGTGTCTGT GAAAAGTCGAATAACCATCAGCCCA GACACATCCAAGAACCAGTTCTCCC TGCAGTTGAATTCTGTGACTCCCGA GGACACGGCTGTCTATTACTGTGCA ACCAGGGGACATAACTACGGTGTAG ATTACTGGGGCCCGGGGACCACGGT CACCGTCTCCTCAGCATCCACCAAG GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GGCTTTTATCCGTCCGACATCGCCG<br>TGGAGTGGGAGTCCAACGGACAAC<br>CGGAGAACAACTACAAGACCACCC<br>CACCCGGTGCTCGATTCCGATGGCTC<br>CTTCTTCCTGTACTCCAAGCTGACTG<br>TGGACAAGTCAAGATGGCAGCAGG<br>GAAACGTGTTCTCCTGCTCCGTGAT<br>GCACGAAGCGCTGCACAACCATTAC<br>ACCCAGAAATCACTGTCACTTTCGC<br>CGGGAAAA |
| SEQ ID 2137 | QVQLVQSGGGLVKPGGSLRLSCAASG<br>FTFSNAWMSWVRQAPGKGLEWVCRI<br>KSKTDGETTDYAAPVKGRFTISRDDSK<br>NTLYLQMNSLKTEDTAVYHCTTGVG<br>WSPFQYWGQGTLVTVSSASTKGPSVF<br>PLAPSSKSTSGGTAALGCLVKDYFPEP<br>VTVSWNSGALTSGVHTFPAVLQSSGL<br>YSLSSVVTVPSSSLGTQTYICNVNHKPS<br>NTKVDKKVEPKSCDKTHTCPPCPAPEL<br>LGGPSVFLFPPKPKDTLMISRTPEVTCV<br>VVDVSHEDPEVKFNWYVDGVEVHNA<br>KTKPREEQYASTYRVVSVLTVLHQDW<br>LNGKEYKCKVSNKALPAPIEKTISKAK<br>GQPREPQVYTLPPSREEMTKNQVSLTC<br>LVKGFYPSDIAVEWESNGQPENNYKT<br>TPPVLDSDGSFFLYSKLTVDKSRWQQG<br>NVFSCSVMHEALHNHYTQKSLSLSPG<br>K | SEQ ID 2245 | CAGGTGCAGCTGGTGCAGTCTGGGG<br>GAGGCTTGGTAAAGCCTGGGGGGTC<br>CCTTAGACTCTCCTGTGCAGCCTCTG<br>GATTCACTTTCAGTAACGCCTGGAT<br>GAGCTGGGTCCGCCAGGCTCCAGGG<br>AAGGGGCTGGAGTGGGTTTGCCGTA<br>TTAAAAGCAAAACTGATGGTGAGAC<br>AACAGACTACGCTGCACCCGTGAAA<br>GGCAGATTCACCATCTCAAGAGATG<br>ATTCAAAAAACACGCTGTATCTGCA<br>AATGAACAGCCTGAAAACTGAGGA<br>CACAGCCGTGTATCACTGTACCACA<br>GGGGTGGGATGGTCGCCCTTCCAAT<br>ACTGGGGCCAGGGCACCCTGGTCAC<br>CGTCTCCTCAGCATCCACCAAGGGG<br>CCTTCCGTGTTCCCCCTGGCCCCTTC<br>ATCCAAGTCGACCTCTGGTGGAACC<br>GCCGCACTCGGTTGCCTGGTCAAAG<br>ACTACTTCCCCGAGCCCGTGACTGT<br>CTCGTGGAACTCGGGCGCCCTCACA<br>TCCGGAGTGCATACCTTTCCCGCCG<br>TGTTGCAGTCCAGCGGCCTGTACAG<br>CCTGAGCTCCGTCGTGACAGTGCCG<br>TCCTCCTCCCTTGGAACCCAGACCT<br>ATATCTGCAACGTCAATCACAAGCC<br>CTCCAACACCAAAGTGGACAAGAA<br>GGTCGAACCCAAGTCCTGCGACAAG<br>ACTCACACCTGTCCGCCTTGTCCAG<br>CCCCTGAGCTGCTGGGTGGTCCGTC<br>CGTGTTCCTCTTCCCGCCCAAGCCG<br>AAGGACACTCTGATGATTTCACGCA<br>CCCCGGAAGTCACTTGCGTGGTCGT<br>GGACGTGTCGCACGAAGATCCCGAA<br>GTGAAATTCAATTGGTACGTGGATG<br>GGGTCGAAGTGCACAACGCCAAGA<br>CCAAGCCTAGGGAAGAACAGTACgc<br>cTCTACGTACCGGGTGGTGTCCGTGC<br>TGACCGTGCTGCACCAGGACTGGCT<br>GAACGGAAAGGAGTACAAGTGCAA<br>AGTGTCAAACAAGGCTCTCCCTGCC<br>CCTATCGAAAAGACCATCAGCAAGG<br>CCAAGGGTCAACCTAGGGAGCCCCA<br>GGTCTACACTTTGCCGCCTAGCCGG<br>GAAGAAATGACTAAGAACCAAGTG<br>TCCCTGACTTGCCTTGTCAAGGGCTT<br>TTATCCGTCCGACATCGCCGTGGAG<br>TGGGAGTCCAACGGACAACCGGAG<br>AACAACTACAAGACCACCCCACCGG<br>TGCTCGATTCCGATGGCTCCTTCTTC<br>CTGTACTCCAAGCTGACTGTGGACA<br>AGTCAAGATGGCAGCAGGGAAACG<br>TGTTCTCCTGCTCCGTGATGCACGA<br>AGCGCTGCACAACCATTACACCCAG<br>AAATCACTGTCACTTTCGCCGGGAA<br>AA |
| SEQ ID 2138 | EVQLVQSGGGLVQPGRSLRLSCTASGF<br>TFGDYAMSWFRQAPGKGLEWVGFIRS<br>KAYGGTTEYAASVKGRFTISRDDSKSI<br>AYLQMNSLKTEDTAVYYCTRDDKIAA<br>AGFTYWYFDLWGRGTLVTVSSASTKG<br>PSVFPLAPSSKSTSGGTAALGCLVKDY<br>FPEPVTVSWNSGALTSGVHTFPAVLQS<br>SGLYSLSSVVTVPSSSLGTQTYICNVNH<br>KPSNTKVDKKVEPKSCDKTHTCPPCPA | SEQ ID 2246 | GAGGTCCAGCTGGTACAGTCTGGGG<br>GAGGCTTGGTACAGCCAGGGCGGTC<br>CCTGAGACTCTCCTGTACAGCTTCT<br>GGATTCACCTTTGGTGATTATGCTAT<br>GAGCTGGTTCCGCCAGGCTCCAGGG<br>AAGGGGCTGGAGTGGGTAGGTTTCA<br>TTAGAAGCAAAGCTTATGGTGGGAC<br>AACAGAATACGCCGCGTCTGTGAAA<br>GGCAGATTCACCATCTCAAGAGATG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | | ATTCCAAAAGCATCGCCTATCTGCA AATGAACAGCCTGAAAACCGAGGA CACAGCCGTGTATTACTGTACTAGA GACGACAAAATAGCAGCAGCTGGA TTCACATACTGGTACTTCGATCTCTG GGGGCCGTGGCACCCTGGTCACCGTC TCCTCAGCATCCACCAAGGGGCCTT CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCCGGGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT CTCCTGCTCCGTGATGCACGAAGCG CTGCACAACCATTACACCCAGAAAT CACTGTCACTTTCGCCGGGAAAA |
| SEQ ID 2139 | QVQLVQSGAEVKKPGASVKVSCKASG YTFAAYYLHWVRQAPGQGLEWMGRI SPGNGVTSYAQKFQGRVTMTGDTSIN TVYMQLNNLISGDTAVYYCAREAADD PFDHWGQGALVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIA VEWESNGQPENNYKTTPPV LDSDGSFFLYSKLTVDKSRWQQGNVF SCSVMHEALHNHYTQKSLSLSPGK | SEQ ID 2247 | CAGGTGCAGCTGGTGCAGTCTGGGG CTGAGGTGAAGAAGCCTGGGGCCTC AGTGAAGGTCTCCTGCAAGGCTTCT GGATACACCTTCGCCGCCTATTATTT ACACTGGGTGCGACAGGCCCCTGGA CAAGGCCTTGAGTGGATGGGCGG ATCAGCCCTGGTAACGGTGTCACAA GTTATGCACAGAAATTTCAGGGCAG AGTCACCATGACCGGGGACACGTCC ATTAACACAGTCTACATGCAACTGA ACAATTTGATTTCTGGCGACACGGC CGTATATTACTGTGCGAGAGAGGCT GCCGACGACCCGTTTGACCATTGGG GCCAGGGAGCCCTGGTCACCGTCTC CTCAGCATCCACCAAGGGGCCTTCC GTGTTCCCCCTGGCCCCTTCATCCAA GTCGACCTCTGGTGGAACCGCCGCA CTCGGTTGCCTGGTCAAAGACTACT TCCCCGAGCCCGTGACTGTCTCGTG GAACTCGGGCGCCCTCACATCCGGA GTGCATACCTTTCCCGCCGTGTTGC AGTCCAGCGGCCTGTACAGCCTGAG CTCCGTCGTGACAGTGCCGTCCTCC TCCCTTGGAACCCAGACCTATATCT GCAACGTCAATCACAAGCCCTCCAA CACCAAAGTGGACAAGAAGGTCGA ACCCAAGTCCTGCGACAAGACTCAC ACCTGTCCGCCTTGTCCAGCCCCTG AGCTGCTGGGTGGTCCGTCCGTGTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCTCTTCCCGCCCAAGCCGAAGGAC ACTCTGATGATTTCACGCACCCCGG AAGTCACTTGCGTGGTCGTGGACGT GTCGCACGAAGATCCCGAAGTGAA ATTCAATTGGTACGTGGATGGGGTC GAAGTGCACAACGCCAAGACCAAG CCTAGGGAAGAACAGTACgccTCTAC GTACCGGGTGGTGTCCGTGCTGACC GTGCTGCACCAGGACTGGCTGAACG GAAAGGAGTACAAGTGCAAAGTGT CAAACAAGGCTCTCCCTGCCCCTAT CGAAAAGACCATCAGCAAGGCCAA GGGTCAACCTAGGGAGCCCCAGGTC TACACTTTGCCGCCTAGCCGGGAAG AAATGACTAAGAACCAAGTGTCCCT GACTTGCCTTGTCAAGGGCTTTTATC CGTCCGACATCGCCGTGGAGTGGGA GTCCAACGGACAACCGGAGAACAA CTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCT GCACAACCATTACACCCAGAAATCA CTGTCACTTTCGCCGGGAAAA |
| SEQ ID 2140 | EVQLVQSGGGVVQPGRSLTLSCAASG FTFSSHLMHWVRQAPGKGLEWVAVIS YDGTSKYYGDSVKGRFTISRDNSKNTL YLQMNSLRAEDTAIYYCAKADYKYD WGQGTLVTVSSASTKGPSVFPLAPSSK STSGGTAALGCLVKDYFPEPVTVSWN SGALTSGVHTFPAVLQSSGLYSLSSVV TVPSSSLGTQTYICNVNHKPSNTKVDK KVEPKSCDKTHTCPPCPAPELLGGPSV FLFPPKPKDTLMISRTPEVTCVVVDVS HEDPEVKFNWYVDGVEVHNAKTKPR EEQYASTYRVVSVLTVLHQDWLNGKE YKCKVSNKALPAPIEKTISKAKGQPRE PQVYTLPPSREEMTKNQVSLTCLVKGF YPSDIAVEWESNGQPENNYKTTPPVLD SDGSFFLYSKLTVDKSRWQQGNVFSCS VMHEALHNHYTQKSLSLSPGK | SEQ ID 2248 | GAAGTGCAGCTGGTGCAGTCTGGGG GAGGCGTGGTCCAGCCTGGGAGGTC CCTGACACTCTCCTGTGCAGCCTCT GGATTCACCTTCAGTTCCCATCTTAT GCACTGGGTCCGCCAGGCTCCAGGC AAGGGGCTGGAGTGGGTGGCAGTT ATATCATATGATGGAACTAGTAAAT ATTACGGAGACTCCGTGAAGGGCCG CTTCACCATCTCCAGAGACAATTCC AAGAACACGTTGTATCTGCAAATGA ACAGCCTGCGAGCTGAAGACACGG CTATATATTACTGTGCGAAAGCAGA TTATAAATATGACTGGGGCCAGGGA ACCCTGGTCACCGTCTCCTCAGCAT CCACCAAGGGGCCTTCCGTGTTCCC CCTGGCCCCTTCATCCAAGTCGACT TCTGGTGGAACCGCCGCACTCGGTT GCCTGGTCAAAGACTACTTCCCCGA GCCCGTGACTGTCTCGTGGAACTCG GGCGCCCTCACATCCGGAGTGCATA CCTTTCCCGCCGTGTTGCAGTCCAG CGGCCTGTACAGCCTGAGCTCCGTC GTGACAGTGCCGTCCTCCTCCCTTG AACCCAGACCTATATCTGCAACGT CAATCACAAGCCCTCCAACACCAAA GTGGACAAGAAGGTCGAACCCAAG TCCTGCGACAAGACTCACACCTGTC CGCCTTGTCCAGCCCCTGAGCTGCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCACG AAGATCCCGAAGTGAAATTCAATTG GTACGTGGATGGGGTCGAAGTGCAC AACGCCAAGACCAAGCCTAGGGAA GAACAGTACgccTCTACGTACCGGGT GGTGTCCGTGCTGACCGTGCTGCAC CAGGACTGGCTGAACGGAAAGGAG TACAAGTGCAAAGTGTCAAACAAG GCTCTCCCTGCCCCTATCGAAAAGA CCATCAGCAAGGCCAAGGGTCAACC TAGGGAGCCCCAGGTCTACACTTTG CCGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GCAGGGAAACGTGTTCTCCTGCTCC GTGATGCACGAAGCGCTGCACAACC ATTACACCCAGAAATCACTGTCACT TTCGCCGGGAAAA |
| SEQ ID 2141 | EVQLVQSGGGLVKPGGSLRLSCTASGF TFGDYAMSWVRQAPGKGLEWVGFIRS KAYGGTTEYAASVKGRFTISRDDSKSI AYLQMNSLKTEDTAVYYCTTHRRPIY DILTGFDYWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2249 | GAGGTGCAGCTGGTGCAGTCTGGGG GAGGCTTGGTCAAGCCTGGAGGGTC CCTGAGACTCTCCTGTACAGCTTCT GGATTCACCTTTGGTGATTATGCTAT GAGCTGGGTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTACT CATAGACGCCCAATTTACGATATTT TGACTGGTTTTGACTACTGGGGCCA GGGAACCCTGGTCACCGTCTCCTCA GCATCCACCAAGGGGCCTTCCGTGT TCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2142 | QLQLQESGGGLVQPGRSLRLSCTASGF TFGDYAMSWVRQAPGKGLEWVGFIRS KAYGGTTEYAASVKGRFTISRDDSKSI AYLQMNSLKTEDTAVYYCTREDTMV RGVIPWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP | SEQ ID 2250 | CAGCTGCAGCTGCAGGAGTCCGGGG GAGGCTTGGTACAGCCAGGGCGGTC CCTGAGACTCTCCTGTACAGCTTCT GGATTCACCTTTGGTGATTATGCTAT GAGCTGGGTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA GAGGATACTATGGTTCGGGGAGTTA TTCCCTGGGGCCAGGGAACCCTGGT CACCGTCTCCTCAGCATCCACCAAG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | VLDSDGSFFLYSKLTVDKSRWQQGNV FSCSVMHEALHNHYTQKSLSLSPGK | | GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCAAGCTGACTG TGGACAAGTCAAGATGGCAGCAGG GAAACGTGTTCTCCTGCTCCGTGAT GCACGAAGCGCTGCACAACCATTAC ACCCAGAAATCACTGTCACTTTCGC CGGGAAAA |
| SEQ ID 2143 | QLQLQESGSGLVKPSQTLSLTCAVSGG SISSGGYSWSWIRQPPGKGLEWIGYIY HSGSTYYNPSLKSRVTISVDRSKNQFSL KLSSVTAADTAVYYCARDRRYYDSSG YYPAYYFDYWGQGTLVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2251 | CAGCTGCAGCTGCAGGAGTCCGGCT CAGGACTGGTGAAGCCTTCACAGAC CCTGTCCCTCACCTGCGCTGTCTCTG GTGGCTCCATCAGCAGTGGTGGTTA CTCCTGGAGCTGGATCCGGCAGCCA CCAGGGAAGGGCCTGGAGTGGATT GGGTACATCTATCATAGTGGGAGCA CCTACTACAACCCGTCCCTCAAGAG TCGAGTCACCATATCAGTAGACAGG TCCAAGAACCAGTTCTCCCTGAAGC TGAGCTCTGTGACCGCCGCGGACAC GGCTGTGTATTACTGTGCGAGAGAT CGGCGTTACTATGATAGTAGTGGTT ATTATCCCGCCTACTACTTTGACTAC TGGGGCCAGGGAACCCTGGTCACCG TCTCCTCAGCATCCACCAAGGGGCC TTCCGTGTTCCCCCTGGCCCCTTCAT CCAAGTCGACCTCTGGTGGAACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCCAGACCTAT ATCTGCAACGTCAATCACAAGCCCT CCAACACCAAAGTGGACAAGAAGG TCGAACCCAAGTCCTGCGACAAGAC TCACACCTGTCCGCCTTGTCCAGCC CCTGAGCTGCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCACGAAGATCCCGAAGT GAAATTCAATTGGTACGTGGATGGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GTCGAAGTGCACAACGCCAAGACC AAGCCTAGGGAAGAACAGTACgccT CTACGTACCGGGTGGTGTCCGTGCT GACCGTGCTGCACCAGGACTGGCTG AACGGAAAGGAGTACAAGTGCAAA GTGTCAAACAAGGCTCTCCCTGCCC CTATCGAAAAGACCATCAGCAAGGC CAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2144 | EVQLVQSGGGLVKPGGSLRLSCAASG FTFSSYSMNWVRQAPGKGLEWVSYIS SSGSYTNYADSVKGRFTISRDNAKNSL YLQINSLRAEDTAIYYCARDGGYDSSG FHFDYWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2252 | GAAGTGCAGCTGGTGCAGTCTGGGG GAGGCCTGGTCAAGCCTGGGGGGTC CCTGAGACTCTCCTGTGCAGCCTCT GGATTCACCTTCAGTAGCTATAGCA TGAACTGGGTCCGCCAGGCTCCAGG GAAGGGGCTGGAGTGGGTTTCATAC ATTAGTAGTAGTGGTAGTTACACAA ACTACGCAGACTCTGTGAAGGGCCG ATTCACCATCTCCAGAGACAACGCC AAGAACTCACTGTATCTGCAAATAA ACAGCCTGAGAGCCGAGGACACGG CCATTTATTACTGTGCGAGAGACGG GGGCTATGATAGTAGTGGTTTTCAC TTTGACTACTGGGGCCAGGGAACCC TGGTCACCGTCTCCTCAGCATCCAC CAAGGGGCCTTCCGTGTTCCCCCTG GCCCCTTCATCCAAGTCGACCTCTG GTGGAACCGCCGCACTCGGTTGCCT GGTCAAAGACTACTTCCCCGAGCCC GTGACTGTCTCGTGGAACTCGGGCG CCCTCACATCCGGAGTGCATACCTT TCCCGCCGTGTTGCAGTCCAGCGGC CTGTACAGCCTGAGCTCCGTCGTGA CAGTGCCGTCCTCCTCCCTTGGAAC CCAGACCTATATCTGCAACGTCAAT CACAAGCCCTCCAACACCAAAGTGG ACAAGAAGGTCGAACCCAAGTCCTG CGACAAGACTCACACCTGTCCGCCT TGTCCAGCCCCTGAGCTGCTGGGTG GTCCGTCCGTGTTCCTCTTCCCGCCC AAGCCGAAGGACACTCTGATGATTT CACGCACCCCGGAAGTCACTTGCGT GGTCGTGGACGTGTCGCACGAAGAT CCCGAAGTGAAATTCAATTGGTACG TGGATGGGGTCGAAGTGCACAACGC CAAGACCAAGCCTAGGGAAGAACA GTACgccTCTACGTACCGGGTGGTGT CCGTGCTGACCGTGCTGCACCAGGA CTGGCTGAACGGAAAGGAGTACAA GTGCAAAGTGTCAAACAAGGCTCTC CCTGCCCCTATCGAAAAGACCATCA GCAAGGCCAAGGGTCAACCTAGGG AGCCCCAGGTCTACACTTTGCCGCC TAGCCGGGAAGAAATGACTAAGAA CCAAGTGTCCCTGACTTGCCTTGTC AAGGGCTTTTATCCGTCCGACATCG CCGTGGAGTGGGAGTCCAACGGAC AACCGGAGAACAACTACAAGACCA CCCCACCGGTGCTCGATTCCGATGG CTCCTTCTTCCTGTACTCCAAGCTGA CTGTGGACAAGTCAAGATGGCAGCA GGGAAACGTGTTCTCCTGCTCCGTG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | ATGCACGAAGCGCTGCACAACCATT ACACCCAGAAATCACTGTCACTTTC GCCGGGAAAA |
| SEQ ID 2145 | QVQLQQSGPGLVKPSQTLSLTCAISGD SVSNNRAAWNWIRQSPSRGLEWLGRT YYRSKWYNEYAVSVKSRITINPDTSKN QFSLQLNSMTPEDSAVYYCAILPSSGY LQDHHYYGMDVWGQGTTVTVSSAST KGPSVFPLAPSSKSTSGGTAALGCLVK DYFPEPVTVSWNSGALTSGVHTFPAVL QSSGLYSLSSVVTVPSSSLGTQTYICNV NHKPSNTKVDKKVEPKSCDKTHTCPP CPAPELLGGPSVFLFPPKPKDTLMISRT PEVTCVVVDVSHEDPEVKFNWYVDG VEVHNAKTKPREEQYASTYRVVSVLT VLHQDWLNGKEYKCKVSNKALPAPIE KTISKAKGQPREPQVYTLPPSREEMTK NQVSLTCLVKGFYPSDIAVEWESNGQP ENNYKTTPPVLDSDGSFFLYSKLTVDK SRWQQGNVFSCSVMHEALHNHYTQK SLSLSPGK | SEQ ID 2253 | CAGGTACAGCTGCAGCAGTCAGGTC CAGGACTGGTGAAGCCCTCGCAGAC CCTCTCACTCACCTGTGCCATCTCCG GGGACAGTGTCTCTAACAACAGGGC TGCTTGGAACTGGATCAGGCAGTCG CCATCGAGAGGCCTTGAGTGGCTGG GAAGGACATACTACAGGTCCAAGTG GTATAATGAATATGCAGTCTCTGTG AAAAGTCGAATAACCATCAACCCAG ACACATCCAAGAACCAGTTCTCCCT GCAGCTGAACTCTATGACTCCCGAG GACTCGGCTGTGTATTACTGTGCAA TTTTGCCTAGTAGTGGTTATCTACAG GACCACCACTACTACGGTATGGACG TCTGGGGCCAAGGGACCACGGTCAC CGTCTCCTCAGCATCCACCAAGGGG CCTTCCGTGTTCCCCCTGGCCCCTTC ATCCAAGTCGACCTCTGGTGGAACC GCCGCACTCGGTTGCCTGGTCAAAG ACTACTTCCCCGAGCCCGTGACTGT CTCGTGGAACTCGGGCGCCCTCACA TCCGGAGTGCATACCTTTCCCGCCG TGTTGCAGTCCAGCGGCCTGTACAG CCTGAGCTCCGTCGTGACAGTGCCG TCCTCCTCCCTTGGAACCCAGACCT ATATCTGCAACGTCAATCACAAGCC CTCCAACACCAAAGTGGACAAGAA GGTCGAACCCAAGTCCTGCGACAAG ACTCACACCTGTCCGCCTTGTCCAG CCCCTGAGCTGCTGGGTGGTCCGTC CGTGTTCCTCTTCCCGCCCAAGCCG AAGGACACTCTGATGATTTCACGCA CCCCCGGAAGTCACTTGCGTGGTCGT GGACGTGTCGCACGAAGATCCCGAA GTGAAATTCAATTGGTACGTGGATG GGGTCGAAGTGCACAACGCCAAGA CCAAGCCTAGGGAAGAACAGTACgc cTCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2146 | EVQLVQSGAEVKKPGASVKVSCKASG YTFTSYGISWVRQAPGQGLEWMGWIS AYNGNTNYAQKLQGRVTMTTDTSTST AYMELSSLRSEDTAVYYCARAAVGDG YSYGRLDWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT | SEQ ID 2254 | GAGGTGCAGCTGGTGCAGTCTGGAG CTGAGGTGAAGAAGCCTGGGGCCTC AGTGAAGGTCTCCTGCAAGGCTTCT GGTTACACCTTTACCAGCTACGGTA TCAGCTGGGTGCGACAGGCCCCTGG ACAAGGGCTTGAGTGGATGGATG GATCAGCGCTTACAATGGTAACACA AACTATGCACAGAAGCTCCAGGGCA GAGTCACCATGACCACAGACACATC CACGAGCACAGCCTACATGGAGCTG AGCAGCCTGAGATCTGAGGACACG GCCGTGTATTACTGTGCGAGAGCCG CGGTGGGGATGGATACAGCTATGG TCGGCTCGATTGGGGCCAGGGAACC CTGGTCACCGTCTCCTCAGCATCCA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | TPPVLDSDGSFFLYSKLTVDKSRWQQG NVFSCSVMHEALHNHYTQKSLSLSPG K | | CCAAGGGGCCTTCCGTGTTCCCCCT GGCCCCTTCATCCAAGTCGACCTCT GGTGGAACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCCAGACCTATATCTGCAACGTCAA TCACAAGCCCTCCAACACCAAAGTG GACAAGAAGGTCGAACCCAAGTCCT GCGACAAGACTCACACCTGTCCGCC TTGTCCAGCCCCTGAGCTGCTGGGT GGTCCGTCCGTGTTCCTCTTCCCGCC CAAGCCGAAGGACACTCTGATGATT TCACGCACCCCGGAAGTCACTTGCG TGGTCGTGGACGTGTCGCACGAAGA TCCCGAAGTGAAATTCAATTGGTAC GTGGATGGGGTCGAAGTGCACAAC GCCAAGACCAAGCCTAGGGAAGAA CAGTACgccTCTACGTACCGGGTGGT GTCCGTGCTGACCGTGCTGCACCAG GACTGGCTGAACGGAAAGGAGTAC AAGTGCAAAGTGTCAAACAAGGCTC TCCCTGCCCCTATCGAAAAGACCAT CAGCAAGGCCAAGGGTCAACCTAG GGAGCCCCAGGTCTACACTTTGCCG CCTAGCCGGGAAGAAATGACTAAG AACCAAGTGTCCCTGACTTGCCTTG TCAAGGGCTTTTATCCGTCCGACAT CGCCGTGGAGTGGGAGTCCAACGG ACAACCGGAGAACAACTACAAGAC CACCCCACCGGTGCTCGATTCCGAT GGCTCCTTCTTCCTGTACTCCAAGCT GACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2147 | EVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARLPSYYYDSS GYFTWYFDLWGRGTLVTVSSASTKGP SVFPLAPSSKSTSGGTAALGCLVKDYF PEPVTVSWNSGALTSGVHTFPPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2255 | GAGGTCCAGCTGGTACAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGACTCCC CTCGTATTACTATGATAGTAGTGGT TACTTTACCTGGTACTTCGATCTCTG GGGCCGTGGCACCCTGGTGACCGTC TCTTCAGCATCCACCAAGGGGCCTT CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CGAAGTGCACAACGCCAAGACCAA |
| | | | GCCTAGGGAAGAACAGTACgccTCTA |
| | | | CGTACCGGGTGGTGTCCGTGCTGAC |
| | | | CGTGCTGCACCAGGACTGGCTGAAC |
| | | | GGAAAGGAGTACAAGTGCAAAGTG |
| | | | TCAAACAAGGCTCTCCCTGCCCCTA |
| | | | TCGAAAAGACCATCAGCAAGGCCA |
| | | | AGGGTCAACCTAGGGAGCCCCAGGT |
| | | | CTACACTTTGCCGCCTAGCCGGGAA |
| | | | GAAATGACTAAGAACCAAGTGTCCC |
| | | | TGACTTGCCTTGTCAAGGGCTTTTAT |
| | | | CCGTCCGACATCGCCGTGGAGTGGG |
| | | | AGTCCAACGGACAACCGGAGAACA |
| | | | ACTACAAGACCACCCCACCGGTGCT |
| | | | CGATTCCGATGGCTCCTTCTTCCTGT |
| | | | ACTCCAAGCTGACTGTGGACAAGTC |
| | | | AAGATGGCAGCAGGGAAACGTGTT |
| | | | CTCCTGCTCCGTGATGCACGAAGCG |
| | | | CTGCACAACCATTACACCCAGAAAT |
| | | | CACTGTCACTTTCGCCGGGAAAA |
| SEQ ID 2148 | EVQLVQSGAEVKKPGASVKVSCKASG YTFTSYGISWVRQAPGQGLEWMGWII PIFGIANYAQKFQGRVTITADKSTSTAY MELSSLRSEDTAVYYCARELYNYGSK DYFDYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2256 | GAGGTCCAGCTGGTACAGTCTGGAG CTGAGGTGAAGAAGCCTGGGGCCTC AGTGAAGGTCTCCTGCAAGGCTTCT GGTTACACCTTTACCAGCTATGGTA TCAGCTGGGTGCGACAGGCCCCTGG ACAAGGGCTTGAGTGGATGGGATG GATCATCCCTATCTTTGGTATAGCA AACTACGCACAGAAGTTCCAGGGCA GAGTCACGATTACCGCGGACAAATC CACGAGCACAGCCTACATGGAGCTG AGCAGCCTGAGATCTGAGGACACG GCCGTGTATTACTGTGCGAGAGAAC TATACAACTATGGTTCAAAGGACTA CTTTGACTACTGGGGCCAGGGAACC CTGGTCACCGTCTCCTCAGCATCCA CCAAGGGGCCTTCCGTGTTCCCCT GGCCCCTTCATCCAAGTCGACCTCT GGTGGAACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCCAGACCTATATCTGCAACGTCAA TCACAAGCCCTCCAACACCAAAGTG GACAAGAAGGTCGAACCCAAGTCCT GCGACAAGACTCACACCTGTCCGCC TTGTCCAGCCCCTGAGCTGCTGGGT GGTCCGTCCGTGTTCCTCTTCCCGCC CAAGCCGAAGGACACTCTGATGATT TCACGCACCCCGGAAGTCACTTGCG TGGTCGTGGACGTGTCGCACGAAGA TCCCGAAGTGAAATTCAATTGGTAC GTGGATGGGGTCGAAGTGCACAAC GCCAAGACCAAGCCTAGGGAAGAA CAGTACgccTCTACGTACCGGGTGGT GTCCGTGCTGACCGTGCTGCACCAG GACTGGCTGAACGGAAAGGAGTAC AAGTGCAAAGTGTCAAACAAGGCTC TCCCTGCCCCTATCGAAAAGACCAT CAGCAAGGCCAAGGGTCAACCTAG GGAGCCCCAGGTCTACACTTTGCCG CCTAGCCGGGAAGAAATGACTAAG AACCAAGTGTCCCTGACTTGCCTTG TCAAGGGCTTTTATCCGTCCGACAT CGCCGTGGAGTGGGAGTCCAACGG ACAACCGGAGAACAACTACAAGAC CACCCCACCGGTGCTCGATTCCGAT GGCTCCTTCTTCCTGTACTCCAAGCT GACTGTGGACAAGTCAAGATGGCA GCAGGGAAACGTGTTCTCCTGCTCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GTGATGCACGAAGCGCTGCACAACC ATTACACCCAGAAATCACTGTCACT TTCGCCGGGAAAA |
| SEQ ID 2149 | EVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARGGTWDTAM VTGFDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2257 | GAAGTGCAGCTGGTGCAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGGGGCGG TACTTGGGATACAGCTATGGTTACG GGCTTTGACTACTGGGGCCAGGGAA CCCTGGTCACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2150 | EVQLVQSGAEVKKPGESLKISCKGSGY SFTSYWIAWVRQMPGKGLEWMGVIYP GDSDTRYSPSFQGQVTISADKSINTAYL QWSSLKASDTAMYYCARPHYDILTGS RAPFDYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ | SEQ ID 2258 | GAAGTGCAGCTGGTGCAGTCTGGAG CAGAGGTGAAAAAGCCCGGGGAGT CTCTGAAGATCTCCTGTAAGGGTTC TGGATACAGCTTTACCAGCTACTGG ATCGCCTGGGTGCGCCAGATGCCCG GGAAAGGCCTGGAGTGGATGGGGG TCATCTATCCTGGTGACTCTGATACC AGATACAGCCCGTCCTTCCAAGGCC AGGTCACCATCTCAGCCGACAAGTC CATCAATACCGCCTACCTGCAGTGG AGCAGCCTGAAGGCCTCGGACACCG CCATGTATTACTGTGCGAGACCCCA TTACGATATTTTGACTGGTTCCCGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | | GCGCCCTTTGACTACTGGGGCCAGGGAACCCTGGTCACCGTCTCCTCAGCATCCACCAAGGGGCCTTCCGTGTTCCCCCTGGCCCCTTCATCCAAGTCGACCTCTGGTGGAACCGCCGCACTCGGTTGCCTGGTCAAAGACTACTTCCCCGAGCCCGTGACTGTCTCGTGGAACTCGGGCGCCCTCACATCCGGAGTGCATACCTTTCCCGCCGTGTTGCAGTCCAGCGGCCTGTACAGCCTGAGCTCCGTCGTGACAGTGCCGTCCTCCTCCCTTGGAACCCAGACCTATATCTGCAACGTCAATCACAAGCCCTCCAACACCAAAGTGGACAAGAAGGTCGAACCCAAGTCCTGCGACAAGACTCACACCTGTCCGCCTTGTCCAGCCCCTGAGCTGCTGGGTGGTCCGTCCGTGTTCCTCTTCCCGCCCAAGCCGAAGGACACTCTGATGATTTCACGCACCCCGGAAGTCACTTGCGTGGTCGTGGACGTGTCGCACGAAGATCCCGAAGTGAAATTCAATTGGTACGTGGATGGGGTCGAAGTGCACAACGCCAAGACCAAGCCTAGGGAAGAACAGTACGccTCTACGTACCGGGTGGTGTCCGTGCTGACCGTGCTGCACCAGGACTGGCTGAACGGAAAGGAGTACAAGTGCAAAGTGTCAAACAAGGCTCTCCCTGCCCCTATCGAAAAGACCATCAGCAAGGCCAAGGGTCAACCTAGGGAGCCCCAGGTCTACACTTTGCCGCCTAGCCGGGAAGAAATGACTAAGAACCAAGTGTCCCTGACTTGCCTTGTCAAGGGCTTTTATCCGTCCGACATCGCCGTGGAGTGGGAGTCCAACGGACAACCGGAGAACAACTACAAGACCACCCCACCGGTGCTCGATTCCGATGGCTCCTTCTTCCTGTACTCCAAGCTGACTGTGGACAAGTCAAGATGGCAGCAGGGAAACGTGTTCTCCTGCTCCGTGATGCACGAAGCGCTGCACAACCATTACACCCAGAAATCACTGTCACTTTCGCCGGGAAAA |
| SEQ ID 2151 | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | SEQ ID 2259 | CAGGTGCAGCTACAGCAGTGGGCGCAGGACTGTTGAAGCCTTCGGAGACCCTGTCCCTCACCTGCGCTGTCTATGGTGGGTCCTTCAGTGGTTACTACTGGAGCTGGATCCGCCAGCCCCCAGGGAAGGGGCTGGAGTGGATTGGGGAAATCAATCATAGTGGAAGCACCAACTACAACCCGTCCCTCAAGAGTCGAGTCACCATATCAGTAGACACGTCCAAGAACCAGTTCTCCCTGAAGCTGAGCTCTGTGACCGCCGCGGACACGGCTGTGTATTACTGTGCGAGAGCCCGAGTGGAATCCAAGGATGGGTACTTTGACTACTGGGGCCAGGGAACCCTGGTCACCGTCTCCTCAGCATCCACCAAGGGGCCATCCGTGTTCCCCCTGGCCCCTTCATCCAAGTCGACCTCTGGTGGAACCGCCGCACTCGGTTGCCTGGTCAAAGACTACTTCCCCGAGCCCGTGACTGTCTCGTGGAACTCGGGCGCCCTCACATCCGGAGTGCATACCTTTCCCGCCGTGTTGCAGTCCAGCGGCCTGTACAGCCTGAGCTCCGTCGTGACAGTGCCGTCCTCCTCCCTTGGAACCCAGACCTATATCTGCAACGTCAATCACAAGCCCTCCAACACCAAAGTGGACAAGAAGGTCGAACCCAAGTCCTGCGACAAGACTCACACCTGTCCGCCTTGTCCAGCCCCTGAGCTGCTGGGTGGTCCGTCCGTGTTCCTCTTCCCGCCCAAGCCGAAGGACACTCTGATGATTTCACGCACCCCGGAAGTCACTTGCGTGGTCGTGGACGTGTCGCACGAAGATCCCGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC CCCTATCGAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA CGTGTTCTCCTGCTCCGTGATGCAC GAAGCGCTGCACAACCATTACACCC AGAAATCACTGTCACTTTCGCCGGG AAAA |
| SEQ ID 2152 | EVQLVESGGGVVQPGRSLRLSCAASGF TFTDAWMNWVRQAPGKGLEWIGRVK NKADGETTDYAAPVKGRITISRDDAK NTLYVQMNSLKTEDTAVYYCTADLRL STWDAYDFWGQGTMVTVSSASTKGPS VFPLAPSSKSTSGGTAALGCLVKDYFP EPVTVSWNSGALTSGVHTFPAVLQSSG LYSLSSVVTVPSSSLGTQTYICNVNHKP SNTKVDKKVEPKSCDKTHTCPPCPAPE LLGGPSVFLFPPKPKDTLMISRTPEVTC VVVDVSHEDPEVKFNWYVDGVEVHN AKTKPREEQYASTYRVVSVLTVLHQD WLNGKEYKCKVSNKALPAPIEKTISKA KGQPREPQVYTLPPSREEMTKNQVSLT CLVKGFYPSDIAVEWESNGQPENNYK TTPPVLDSDGSFFLYSKLTVDKSRWQQ GNVFSCSVMHEALHNHYTQKSLSLSP GK | SEQ ID 2260 | GAGGTGCAGCTGGTGGAGTCTGGGG GAGGCGTGGTCCAGCCTGGGAGGTC CCTGAGACTCTCCTGTGCAGCCTCT GGATTCACTTTCACTGATGCCTGGA TGAACTGGGTCCGCCAGGCTCCAGG GAAGGGGCTGGAGTGGATTGGCCGT GTTAAAAACAAAGCTGATGGTGAG ACAACGGACTACGCTGCACCCGTCA AAGGCAGAATCACCATCTCAAGAG ATGATGCAAAGAACACTCTGTATGT GCAAATGAACAGCCTGAAAACCGA GGACACAGCCGTGTATTATTGTACC GCTGACCTGCGACTTTCTACGTGGG ATGCTTATGATTTCTGGGGCCAAGG GACAATGGTCACCGTCTCTTCAGCA TCCACCAAGGGGCCTTCCGTGTTCC CCCTGGCCCCTTCATCCAAGTCGAC CTCTGGTGGAACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2153 | QITLKESGGGLVQPGGSLRLSCTVSGF TFSNNWMTWVRQTPGKGLEWVANIK QDGTEKHYVDSVKGRFTISRDNAENSL YLQMNSLRGEDTAVYYCARNSQRSFD YWGQGTLVTVSSASTKGPSVFPLAPSS KSTSGGTAALGCLVKDYFPEPVTVSW NSGALTSGVHTFPAVLQSSGLYSLSSV VTVPSSSLGTQTYICNVNHKPSNTKVD KKVEPKSCDKTHTCPPCPAPELLGGPS VFLFPPKPKDTLMISRTPEVTCVVVDV SHEDPEVKFNWYVDGVEVHNAKTKP REEQYASTYRVVSVLTVLHQDWLNGK EYKCKVSNKALPAPIEKTISKAKGQPR EPQVYTLPPSREEMTKNQVSLTCLVKG FYPSDIAVEWESNGQPENNYKTTPPVL DSDGSFFLYSKLTVDKSRWQQGNVFS CSVMHEALHNHYTQKSLSLSPGK | SEQ ID 2261 | CAGATCACCTTGAAGGAGTCTGGGG GAGGCTTGGTCCAGCCTGGGGGGTC CCTAAGACTCTCTTGTACAGTCTCA GGATTCACCTTTAGTAACAATTGGA TGACCTGGGTCCGCCAGACTCCAGG GAAGGGGCTGGAGTGGGTGGCCAA CATAAAGCAAGATGGAACTGAGAA ACACTATGTGGACTCTGTGAAGGGC CGATTCACCATCTCCAGAGACAACG CCGAGAACTCACTGTATCTGCAGAT GAACAGCCTGAGAGGTGAGGACAC GGCCGTGTATTATTGTGCGAGAAAC AGTCAACGTTCGTTTGACTACTGGG GCCAGGGCACCCTGGTGACCGTCTC CTCAGCATCCACCAAGGGGCCTTCC GTGTTCCCCCTGGCCCCTTCATCCAA GTCGACCTCTGGTGGAACCGCCGCA CTCGGTTGCCTGGTCAAAGACTACT TCCCCGAGCCCGTGACTGTCTCGTG GAACTCGGGCGCCCTCACATCCGGA GTGCATACCTTTCCCGCCGTGTTGC AGTCCAGCGGCCTGTACAGCCTGAG CTCCGTCGTGACAGTGCCGTCCTCC TCCCTTGGAACCCAGACCTATATCT GCAACGTCAATCACAAGCCCTCCAA CACCAAAGTGGACAAGAAGGTCGA ACCCAAGTCCTGCGACAAGACTCAC ACCTGTCCGCCTTGTCCAGCCCCTG AGCTGCTGGGTGGTCCGTCCGTGTT CCTCTTCCCGCCCAAGCCGAAGGAC ACTCTGATGATTTCACGCACCCCGG AAGTCACTTGCGTGGTCGTGGACGT GTCGCACGAAGATCCCGAAGTGAA ATTCAATTGGTACGTGGATGGGGTC GAAGTGCACAACGCCAAGACCAAG CCTAGGGAAGAACAGTACgccTCTAC GTACCGGGTGGTGTCCGTGCTGACC GTGCTGCACCAGGACTGGCTGAACG GAAAGGAGTACAAGTGCAAAGTGT CAAACAAGGCTCTCCCTGCCCCTAT CGAAAAGACCATCAGCAAGGCCAA GGGTCAACCTAGGGAGCCCCAGGTC TACACTTTGCCGCCTAGCCGGGAAG AAATGACTAAGAACCAAGTGTCCCT GACTTGCCTTGTCAAGGGCTTTTATC CGTCCGACATCGCCGTGGAGTGGGA GTCCAACGGACAACCGGAGAACAA CTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCT GCACAACCATTACACCCAGAAATCA CTGTCACTTTCGCCGGGAAAA |
| SEQ ID 2154 | QVTLKESGGGVVQPGRSLRLSCAASGF TFSSYGMHWVRQAPGKGLEWVAVISY DGSNKYYADSVKGRFTISRDNSKNTL YLQMNSLRAEDTAVYYCAKDLGDPR GGILNYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV | SEQ ID 2262 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGGCA TGCACTGGGTCCGCCAGGCTCCAGG CAAGGGGCTGGAGTGGGTGGCAGTT ATATCATATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCAAAAGATTT AGGGGATCCCCGGGGTGGTATTTTG AACTACTGGGGCCAGGGCACCCTGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | KGFYPSDIAVEWESNGQPENNYKTTPP VLDSDGSFFLYSKLTVDKSRWQQGNV FSCSVMHEALHNHYTQKSLSLSPGK | | TCACCGTCTCCTCAGCATCCACCAA GGGGCCTTCCGTGTTCCCCCTGGCC CCTTCATCCAAGTCGACCTCTGGTG AACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC AAGCCCTCCAACACCAAAGTGGACA AGAAGGTCGAACCCAAGTCCTGCGA CAAGACTCACACCTGTCCGCCTTGT CCAGCCCCTGAGCTGCTGGGTGGTC CGTCCGTGTTCCTCTTCCCGCCCAAG CCGAAGGACACTCTGATGATTTCAC GCACCCCGGAAGTCACTTGCGTGGT CGTGGACGTGTCGCACGAAGATCCC GAAGTGAAATTCAATTGGTACGTGG ATGGGGTCGAAGTGCACAACGCCA AGACCAAGCCTAGGGAAGAACAGT ACgccTCTACGTACCGGGTGGTGTCC GTGCTGACCGTGCTGCACCAGGACT GGCTGAACGGAAAGGAGTACAAGT GCAAAGTGTCAAACAAGGCTCTCCC TGCCCCTATCGAAAAGACCATCAGC AAGGCCAAGGGTCAACCTAGGGAG CCCCAGGTCTACACTTTGCCGCCTA GCCGGGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCAAGCTGACT GTGGACAAGTCAAGATGGCAGCAG GGAAACGTGTTCTCCTGCTCCGTGA TGCACGAAGCGCTGCACAACCATTA CACCCAGAAATCACTGTCACTTTCG CCGGGAAAA |
| SEQ ID 2155 | EVQLVESGGGVVQPGRSLRLSCAASGF TFSSYAMHWVRQAPGKGLEWVAVISY DGSNKYYADSVKGRFTISRDNSKNTL YLQMNSLRAEDTAVYYCARSSPWGEL SLYQGAFDIWGQGTMVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2263 | GAGGTGCAGCTGGTGGAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCCCGGTCGAG CCCCTGGGGGGAGTTATCGTTATAC CAGGGGGCTTTTGATATCTGGGGCC AAGGGACAATGGTCACCGTCTCTTC AGCATCCACCAAGGGGCCTTCCGTG TTCCCCCTGGCCCCTTCATCCAAGT GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2156 | QITLKESGGGLVQPGRSLRLSCAASGF TFDDYAMHWVRQAPGKGLEWVSAIS GSGGSTYYADSVKGRFTISRDNSKNTL YLQMNSLRAEDTAVYYCAKDNDFWS GKVFDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2264 | CAGATCACCTTGAAGGAGTCTGGGG GAGGCTTGGTACAGCCTGGCAGGTC CCTGAGACTCTCCTGTGCAGCCTCT GGATTCACCTTTGATGATTATGCCA TGCACTGGGTCCGGCAAGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGATAA CGATTTTTGGAGTGGGAAAGTCTTT GACTACTGGGGCCAGGGCACCCTGG TCACCGTCTCCTCAGCATCCACCAA GGGGCCTTCCGTGTTCCCCCTGGCC CCTTCATCCAAGTCGACCTCTGGTG GAACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC AAGCCCTCCAACACCAAAGTGGACA AGAAGGTCGAACCCAAGTCCTGCGA CAAGACTCACACCTGTCCGCCTTGT CCAGCCCCTGAGCTGCTGGGTGGTC CGTCCGTGTTCCTCTTCCCGCCCAAG CCGAAGGACACTCTGATGATTTCAC GCACCCCGGAAGTCACTTGCGTGGT CGTGGACGTGTCGCACGAAGATCCC GAAGTGAAATTCAATTGGTACGTGG ATGGGGTCGAAGTGCACAACGCCA AGACCAAGCCTAGGGAAGAACAGT ACgccTCTACGTACCGGGTGGTGTCC GTGCTGACCGTGCTGCACCAGGACT GGCTGAACGGAAAGGAGTACAAGT GCAAAGTGTCAAACAAGGCTCTCCC TGCCCCTATCGAAAAGACCATCAGC AAGGCCAAGGGTCAACCTAGGGAG CCCCAGGTCTACACTTTGCCGCCTA GCCGGGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCAAGCTGACT GTGGACAAGTCAAGATGGCAGCAG GGAAACGTGTTCTCCTGCTCCGTGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TGCACGAAGCGCTGCACAACCATTA<br>CACCCAGAAATCACTGTCACTTTCG<br>CCGGGAAAA |
| SEQ ID 2157 | EVQLVQSGGGLVQPGGSLRLSCAASG<br>FTFSSYSMNWVRQAPGKGLEWVSYIS<br>STSSTIYYADSVKGRFTISRDNSKNMLF<br>LQMNSLRAEDTAVYYCAKEGGSGWR<br>HYFDYWGQGTLVTVSSASTKGPSVFP<br>LAPSSKSTSGGTAALGCLVKDYFPEPV<br>TVSWNSGALTSGVHTFPAVLQSSGLYS<br>LSSVVTVPSSSLGTQTYICNVNHKPSNT<br>KVDKKVEPKSCDKTHTCPPCPAPELLG<br>GPSVFLFPPKPKDTLMISRTPEVTCVVV<br>DVSHEDPEVKFNWYVDGVEVHNAKT<br>KPREEQYASTYRVVSVLTVLHQDWLN<br>GKEYKCKVSNKALPAPIEKTISKAKGQ<br>PREPQVYTLPPSREEMTKNQVSLTCLV<br>KGFYPSDIAVEWESNGQPENNYKTTPP<br>VLDSDGSFFLYSKLTVDKSRWQQGNV<br>FSCSVMHEALHNHYTQKSLSLSPGK | SEQ ID 2265 | GAAGTGCAGCTGGTGCAGTCTGGGG<br>GAGGCTTGGTACAGCCTGGGGGGTC<br>CCTGAGACTCTCCTGTGCAGCCTCT<br>GGATTCACCTTCAGTAGTTATAGCA<br>TGAACTGGGTCCGCCAGGCTCCAGG<br>GAAGGGGCTGGAGTGGGTTTCATAC<br>ATCAGTAGTACTAGTAGTACCATAT<br>ACTACGCAGACTCCGTGAAGGGCCG<br>ATTCACCATCTCCAGAGACAATTCC<br>AAGAATATGCTGTTTCTACAAATGA<br>ACAGCCTGAGAGCTGAGGACACGG<br>CTGTGTATTACTGTGCGAAAGAAGG<br>GGGCAGTGGCTGGCGCCACTACTTT<br>GACTACTGGGGCCAGGGAACCCTGG<br>TCACCGTCTCCTCAGCATCCACCAA<br>GGGGCCTTCCGTGTTCCCCCTGGCC<br>CCTTCATCCAAGTCGACCTCTGGTG<br>GAACCGCCGCACTCGGTTGCCTGGT<br>CAAAGACTACTTCCCCGAGCCCGTG<br>ACTGTCTCGTGGAACTCGGGCGCCC<br>TCACATCCGGAGTGCATACCTTTCC<br>CGCCGTGTTGCAGTCCAGCGGCCTG<br>TACAGCCTGAGCTCCGTCGTGACAG<br>TGCCGTCCTCCTCCCTTGGAACCCA<br>GACCTATATCTGCAACGTCAATCAC<br>AAGCCCTCCAACACCAAAGTGGACA<br>AGAAGGTCGAACCCAAGTCCTGCGA<br>CAAGACTCACACCTGTCCGCCTTGT<br>CCAGCCCCTGAGCTGCTGGGTGGTC<br>CGTCCGTGTTCCTCTTCCCGCCCAAG<br>CCGAAGGACACTCTGATGATTTCAC<br>GCACCCCGGAAGTCACTTGCGTGGT<br>CGTGGACGTGTCGCACGAAGATCCC<br>GAAGTGAAATTCAATTGGTACGTGG<br>ATGGGGTCGAAGTGCACAACGCCA<br>AGACCAAGCCTAGGGAAGAACAGT<br>ACgccTCTACGTACCGGGTGGTGTCC<br>GTGCTGACCGTGCTGCACCAGGACT<br>GGCTGAACGGAAAGGAGTACAAGT<br>GCAAAGTGTCAAACAAGGCTCTCCC<br>TGCCCCTATCGAAAAGACCATCAGC<br>AAGGCCAAGGGTCAACCTAGGGAG<br>CCCCAGGTCTACACTTTGCCGCCTA<br>GCCGGGAAGAAATGACTAAGAACC<br>AAGTGTCCCTGACTTGCCTTGTCAA<br>GGGCTTTTATCCGTCCGACATCGCC<br>GTGGAGTGGGAGTCCAACGGACAA<br>CCGGAGAACAACTACAAGACCACC<br>CCACCGGTGCTCGATTCCGATGGCT<br>CCTTCTTCCTGTACTCCAAGCTGACT<br>GTGGACAAGTCAAGATGGCAGCAG<br>GGAAACGTGTTCTCCTGCTCCGTGA<br>TGCACGAAGCGCTGCACAACCATTA<br>CACCCAGAAATCACTGTCACTTTCG<br>CCGGGAAAA |
| SEQ ID 2158 | QVTLKESGGGVVQPGRSLRLSCAASGF<br>TFSSYAMHWVRQAPGKGLEWVAVISY<br>DGSNKYYADSVKGRFTISRDNSKNTL<br>YLQMNSLRAEDTAVYYCARDYCSSTS<br>CQNWFDPWGQGTLVTVSSASTKGPSV<br>FPLAPSSKSTSGGTAALGCLVKDYFPE<br>PVTVSWNSGALTSGVHTFPAVLQSSGL<br>YSLSSVVTVPSSSLGTQTYICNVNHKPS<br>NTKVDKKVEPKSCDKTHTCPPCPAPEL<br>LGGPSVFLFPPKPKDTLMISRTPEVTCV<br>VVDVSHEDPEVKFNWYVDGVEVHNA<br>KTKPREEQYASTYRVVSVLTVLHQDW<br>LNGKEYKCKVSNKALPAPIEKTISKAK<br>GQPREPQVYTLPPSREEMTKNQVSLTC | SEQ ID 2266 | CAGGTCACCTTGAAGGAGTCTGGGG<br>GAGGCGTGGTCCAGCCTGGGAGGT<br>CCTGAGACTCTGTCCTGTGCAGCCTCT<br>GGATTCACCTTCAGCAGCTATGCTA<br>TGCACTGGGTCCGCCAGGCTCCAGG<br>CAAGGGGCTGGAGTGGGTGGCAGTT<br>ATATCATATGATGGAAGTAATAAAT<br>ACTACGCAGACTCCGTGAAGGGCCG<br>ATTCACCATCTCCAGAGACAATTCC<br>AAGAACACGTGTATCTGCAAATGA<br>ACAGCCTGAGAGCTGAGGACACGG<br>CTGTGTATTACTGTGCGAGAGATTA<br>TTGTAGTAGTACCAGCTGCCAGAAC<br>TGGTTCGACCCCTGGGGCCAGGGCA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | LVKGFYPSDIAVEWESNGQPENNYKT TPPVLDSDGSFFLYSKLTVDKSRWQQG NVFSCSVMHEALHNHYTQKSLSLSPG K | | CCCTGGTCACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATACTGTCACT TTCGCCGGGAAAA |
| SEQ ID 2159 | QVQLVQSGGGLVQPGGSLRLSCAASG FTFSNYVMSWVRQAPGKGLEWVSAIS GIGDTTYYADSVKGRFTISRDNAKNTL YLQMNSLRAEDTAVYYCARGRVAGD AFDIWGQGTMVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2267 | CAGGTCCAGCTGGTGCAGTCTGGGG GAGGCTTGGTACAGCCTGGGGGGTC CCTGAGACTCTCCTGTGCAGCCTCT GGATTCACCTTTAGCAACTATGTCA TGAGCTGGGTCCGCCAGGCTCCAGG GAAGGGGCTGGAGTGGGTCTCAGCT ATTAGTGGTATTGGTGATACTACAT ACTACGCGGACTCCGTGAAGGGCCG ATTCACCATCTCCAGAGACAACGCC AAGAACACGCTGTATCTGCAAATGA ACAGTCTGAGAGCCGAGGACACGG CTGTGTATTACTGTGCAAGAGGGCG CGTGGCGGGGATGCTTTTGATATC TGGGGCCAAGGGACAATGGTGACC GTCTCTTCAGCATCCACCAAGGGGC CTTCCGTGTTCCCCCTGGCCCCTTCA TCCAAGTCGACCTCTGGTGGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GGTCGAAGTGCACAACGCCAAGAC<br>CAAGCCTAGGGAAGAACAGTACgcc<br>TCTACGTACCGGGTGGTGTCCGTGC<br>TGACCGTGCTGCACCAGGACTGGCT<br>GAACGGAAAGGAGTACAAGTGCAA<br>AGTGTCAAACAAGGCTCTCCCTGCC<br>CCTATCGAAAAGACCATCAGCAAGG<br>CCAAGGGTCAACCTAGGGAGCCCCA<br>GGTCTACACTTTGCCGCCTAGCCGG<br>GAAGAAATGACTAAGAACCAAGTG<br>TCCCTGACTTGCCTTGTCAAGGGCTT<br>TTATCCGTCCGACATCGCCGTGGAG<br>TGGGAGTCCAACGGACAACCGGAG<br>AACAACTACAAGACCACCCCACCGG<br>TGCTCGATTCCGATGGCTCCTTCTTC<br>CTGTACTCCAAGCTGACTGTGGACA<br>AGTCAAGATGGCAGCAGGGAAACG<br>TGTTCTCCTGCTCCGTGATGCACGA<br>AGCGCTGCACAACCATTACACCCAG<br>AAATCACTGTCACTTTCGCCGGGAA<br>AA |
| SEQ ID<br>2160 | QLQLQESGGGLVQPGGSLRLSCAASGF<br>TFSSYAMSWVRQAPGKGLEWVSAISG<br>SGGSTYYADSVKGRFTISRDNSKNTLY<br>LQMNSLRAEDTAVYYCAKDQGAAAG<br>TLGYFDYWGQGTLVTVSSASTKGPSV<br>FPLAPSSKSTSGGTAALGCLVKDYFPE<br>PVTVSWNSGALTSGVHTFPAVLQSSGL<br>YSLSSVVTVPSSSLGTQTYICNVNHKPS<br>NTKVDKKVEPKSCDKTHTCPPCPAPEL<br>LGGPSVFLFPPKPKDTLMISRTPEVTCV<br>VVDVSHEDPEVKFNWYVDGVEVHNA<br>KTKPREEQYASTYRVVSVLTVLHQDW<br>LNGKEYKCKVSNKALPAPIEKTISKAK<br>GQPREPQVYTLPPSREEMTKNQVSLTC<br>LVKGFYPSDIAVEWESNGQPENNYKT<br>TPPVLDSDGSFFLYSKLTVDKSRWQQG<br>NVFSCSVMHEALHNHYTQKSLSLSPG<br>K | SEQ ID<br>2268 | CAGCTGCAGCTGCAGGAGTCGGGG<br>GGAGGCTTGGTACAGCCTGGGGGGT<br>CCCTGAGACTCTCCTGTGCAGCCTC<br>TGGATTCACCTTTAGCAGCTATGCC<br>ATGAGCTGGGTCCGCCAGGCTCCAG<br>GGAAGGGGCTGGAGTGGGTCTCAG<br>CTATTAGTGGTAGTGGTGGTAGCAC<br>ATACTACGCAGACTCCGTGAAGGGC<br>CGGTTCACCATCTCCAGAGACAATT<br>CCAAGAACACGCTGTATCTGCAAAT<br>GAACAGCCTGAGAGCCGAGGACAC<br>GGCCGTATATTACTGTGCGAAAGAT<br>CAAGGGGCAGCAGCTGGTACCCTGG<br>GGTTACTTTGACTACTGGGGCCAGGG<br>AACCCTGGTGACCGTCTCCTCAGCA<br>TCCACCAAGGGCCCTTCCGTGTTCC<br>CCCTGGCCCCTTCATCCAAGTCGAC<br>CTCTGGTGGAACCGCCGCACTCGGT<br>TGCCTGGTCAAAGACTACTTCCCCG<br>AGCCCGTGACTGTCTCGTGGAACTC<br>GGGCGCCCTCACATCCGGAGTGCAT<br>ACCTTTCCCGCCGTGTTGCAGTCCA<br>GCGGCCTGTACAGCCTGAGCTCCGT<br>CGTGACAGTGCCGTCCTCCTCCCTT<br>GGAACCCAGACCTATATCTGCAACG<br>TCAATCACAAGCCCTCCAACACCAA<br>AGTGGACAAGAAGGTCGAACCCAA<br>GTCCTGCGACAAGACTCACACCTGT<br>CCGCCTTGTCCAGCCCCTGAGCTGC<br>TGGGTGGTCCGTCCGTGTTCCTCTTC<br>CCGCCCAAGCCGAAGGACACTCTGA<br>TGATTTCACGCACCCCGGAAGTCAC<br>TTGCGTGGTCGTGGACGTGTCGCAC<br>GAAGATCCCGAAGTGAAATTCAATT<br>GGTACGTGGATGGGGTCGAAGTGCA<br>CAACGCCAAGACCAAGCCTAGGGA<br>AGAACAGTACgccTCTACGTACCGGG<br>TGGTGTCCGTGCTGACCGTGCTGCA<br>CCAGGACTGGCTGAACGGAAAGGA<br>GTACAAGTGCAAAGTGTCAAACAA<br>GGCTCTCCCTGCCCCTATCGAAAAG<br>ACCATCAGCAAGGCCAAGGGTCAA<br>CCTAGGGAGCCCCAGGTCTACACTT<br>TGCCGCCTAGCCGGGAAGAAATGAC<br>TAAGAACCAAGTGTCCCTGACTTGC<br>CTTGTCAAGGGCTTTTATCCGTCCG<br>ACATCGCCGTGGAGTGGGAGTCCAA<br>CGGACAACCGGAGAACAACTACAA<br>GACCACCCCACCGGTGCTCGATTCC<br>GATGGCTCCTTCTTCCTGTACTCCAA<br>GCTGACTGTGGACAAGTCAAGATGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2161 | QVQLVQSGAEVKKPGASVKVSCKASG YTFTSYDINWVRQATGQGLEWMGWM NPNSGNTGYAQKFQGRVTMTRNTSIST AYMELSSLRSEDTAVYYCTRGIYDSSG SSNPFDSWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2269 | CAGGTGCAGCTGGTGCAGTCTGGGG CTGAGGTGAAGAAGCCTGGGGCCTC AGTGAAGGTCTCCTGCAAGGCTTCT GGATACACCTTCACCAGTTATGATA TCAACTGGGTGCGACAGGCCACTGG ACAAGGGCTTGAGTGGATGGGATG GATGAACCCTAACAGTGGTAACACA GGCTACGCACAGAAGTTCCAGGGCA GAGTCACCATGACCAGGAACACCTC CATAAGCACAGCCTACATGGAGCTG AGCAGCCTGAGATCTGAGGACACG GCCGTGTATTACTGTACGAGGAGGAA TCTATGATAGTAGTGGTTCTTCCAAT CCCTTTGACTCCTGGGGCCAGGGAA CCCTGGTGACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2162 | EVQLVQSGAEVKKPGASVKISCEASGY TFTDYAIHWVRQAPGQRLEWMGWIN AGDGGTKSSREFQGRVTITRDTSATTA YMEVSSLRSEDTAVYYCARGYCSGGS CPGTDFDYWGQGTLVTVSSASTKGPS VFPLAPSSKSTSGGTAALGCLVKDYFP EPVTVSWNSGALTSGVHTFPAVLQSSG LYSLSSVVTVPSSSLGTQTYICNVNHKP SNTKVDKKVEPKSCDKTHTCPPCPAPE LLGGPSVFLFPPKPKDTLMISRTPEVTC VVVDVSHEDPEVKFNWYVDGVEVHN AKTKPREEQYASTYRVVSVLTVLHQD WLNGKEYKCKVSNKALPAPIEKTISKA KGQPREPQVYTLPPSREEMTKNQVSLT CLVKGFYPSDIAVEWESNGQPENNYK | SEQ ID 2270 | GAGGTGCAGCTGGTGCAGTCTGGGG CTGAGGTGAAGAAGCCTGGGGCCTC AGTGAAGATTTCCTGCGAGGCTTCT GGATACACCTTCACTGATTATGCTA TACATTGGGTGCGCCAGGCCCCCGG ACAAAGACTTGAGTGGATGGGATG GATCAACGCTGGCGATGGTGGCACA AAAAGTTCACGGGAGTTCCAGGGCA GAGTCACCATTACCAGGGACACATC CGCGACCACAGCCTACATGGAGGTG AGCAGCCTGAGATCTGAAGACACG CTGTCTATTACTGTGCGAGAGGATA TTGTAGTGGTGGTAGCTGCCCAGGA ACGGATTTTGACTACTGGGGCCAGG GAACCCTGGTCACCGTCTCCTCAGC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | TTPPVLDSDGSFFLYSKLTVDKSRWQQ GNVFSCSVMHEALHNHYTQKSLSLSP GK | | ATCCACCAAGGGGCCTTCCGTGTTC CCCCTGGCCCCTTCATCCAAGTCGA CCTCTGGTGGAACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2163 | QVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCARDGVGGRD GYNFDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2271 | CAGGTGCAGCTGGTGCAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGAGATG GTGTAGGAGGGAGAGATGGCTACA ATTTTGACTACTGGGGCCAGGGAAC CCTGGTCACCGTCTCCTCAGCATCC ACCAAGGGGCCTTCCGTGTTCCCCC TGGCCCCTTCATCCAAGTCGACCTC TGGTGGAACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCCAGACCTATATCTGCAACGTCA ATCACAAGCCCTCCAACACCAAAGT GGACAAGAAGGTCGAACCCAAGTC CTGCGACAAGACTCACACCTGTCCG CCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCACGAA GATCCCGAAGTGAAATTCAATTGGT ACGTGGATGGGGTCGAAGTGCACA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2164 | EVQLVQSGGGLVQPGGSLRLSCAASG FTVSSNYMSWVRQAPGKGLEWVSVIY SGGSTYYADSVKGRFTISRDNSKNTLY LQMNSLRAEDTAVYYCARAPLAADG YFDYWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2272 | GAAGTGCAGCTGGTGCAGTCTGGGG GAGGCTTGGTCCAGCCTGGGGGGTC CCTGAGACTCTCCTGTGCAGCCTCT GGATTCACCGTCAGTAGCAACTACA TGAGCTGGGTCCGCCAGGCTCCAGG GAAGGGGCTGGAGTGGGTCTCAGTT ATTTATAGCGGTGGTAGCACATACT ACGCAGACTCCGTGAAGGGCCGATT CACCATCTCCAGAGACAATTCCAAG AACACGCTGTATCTTCAAATGAACA GCCTGAGAGCTGAGGACACGGCTGT GTATTACTGTGCGAGAGCCCCCCTA GCAGCAGATGGCTACTTTGACTACT GGGGCCAGGGAACCCTGGTCACCGT CTCCTCAGCATCCACCAAGGGGCCT TCCGTGTTCCCCCTGGCCCCTTCATC CAAGTCGACCTCTGGTGGAACCGCC GCACTCGGTTGCCTGGTCAAAGACT ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCCAGACCTATA TCTGCAACGTCAATCACAAGCCCTC CAACACCAAAGTGGACAAGAAGGT CGAACCCAAGTCCTGCGACAAGACT CACACCTGTCCGCCTTGTCCAGCCC CTGAGCTGCTGGGTGGTCCGTCCGT GTTCCTCTTCCCGCCCAAGCCGAAG GACACTCTGATGATTTCACGCACCC CGGAAGTCACTTGCGTGGTCGTGGA CGTGTCGCACGAAGATCCCGAAGTG AAATTCAATTGGTACGTGGATGGGG TCGAAGTGCACAACGCCAAGACCA AGCCTAGGGAAGAACAGTACgccTCT ACGTACCGGGTGGTGTCCGTGCTGA CCGTGCTGCACCAGGACTGGCTGAA CGGAAAGGAGTACAAGTGCAAAGT GTCAAACAAGGCTCTCCCTGCCCCT ATCGAAAAGACCATCAGCAAGGCC AAGGGTCAACCTAGGGAGCCCCAG GTCTACACTTTGCCGCCTAGCCGGG AAGAAATGACTAAGAACCAAGTGT CCCTGACTTGCCTTGTCAAGGGCTTT TATCCGTCCGACATCGCCGTGGAGT GGGAGTCCAACGGACAACCGGAGA ACAACTACAAGACCACCCCACCGGT GCTCGATTCCGATGGCTCCTTCTTCC TGTACTCCAAGCTGACTGTGGACAA GTCAAGATGGCAGCAGGGAAACGT GTTCTCCTGCTCCGTGATGCACGAA GCGCTGCACAACCATTACACCCAGA AATCACTGTCACTTTCGCCGGGAAA A |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| SEQ ID 2165 | EVQLVQSGAEVKKPGSSVKVSCKASG GTFSSYAISWVRQAPGQGLEWMGGIIP IFGTANYAQKFQGRVTITADESTSTAY MELSSLRSEDTAVYYCARARGLQYLI WYFDLWGRGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2273 | GAGGTCCAGCTGGTGCAGTCTGGGG CTGAGGTGAAGAAGCCTGGGTCCTC GGTGAAGGTCTCCTGCAAGGCTTCT GGAGGCACCTTCAGCAGCTATGCTA TCAGCTGGGTGCGACAGGCCCCTGG ACAAGGGCTTGAGTGGATGGGAGG GATCATCCCTATCTTTGGTACAGCA AACTACGCACAGAAGTTCCAGGGCA GAGTCACGATTACCGCGGACGAATC CACGAGCACAGCCTACATGGAGCTG AGCAGCCTGAGATCTGAGGACACG GCCGTGTATTACTGTGCGAGAGCCC GGGGGCTACAGTACCTAATCTGGTA CTTCGATCTCTGGGGCCGTGGCACC CTGGTGACCGTCTCCTCAGCATCCA CCAAGGGGCCTTCCGTGTTCCCCCT GGCCCCTTCATCCAAGTCGACCTCT GGTGGAACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCCAGACCTATATCTGCAACGTCAA TCACAAGCCCTCCAACACCAAAGTG GACAAGAAGGTCGAACCCAAGTCCT GCGACAAGACTCACACCTGTCCGCC TTGTCCAGCCCCTGAGCTGCTGGGT GGTCCGTCCGTGTTCCTCTTCCCGCC CAAGCCGAAGGACACTCTGATGATT TCACGCACCCCGGAAGTCACTTGCG TGGTCGTGGACGTGTCGCACGAAGA TCCCGAAGTGAAATTCAATTGGTAC GTGGATGGGGTCGAAGTGCACAAC GCCAAGACCAAGCCTAGGGAAGAA CAGTACgccTCTACGTACCGGGTGGT GTCCGTGCTGACCGTGCTGCACCAG GACTGGCTGAACGGAAAGGAGTAC AAGTGCAAAGTGTCAAACAAGGCTC TCCCTGCCCCTATCGAAAAGACCAT CAGCAAGGCCAAGGGTCAACCTAG GGAGCCCCAGGTCTACACTTTGCCG CCTAGCCGGGAAGAAATGACTAAG AACCAAGTGTCCCTGACTTGCCTTG TCAAGGGCTTTTATCCGTCCGACAT CGCCGTGGAGTGGGAGTCCAACGG ACAACCGGAGAACAACTACAAGAC CACCCCACCGGTGCTCGATTCCGAT GGCTCCTTCTTCCTGTACTCCAAGCT GACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2166 | QVQLVQSGAEVKKPGASVKVSCKASG YTFTSYYMHWVRQAPGQGLEWMGIIN PSGGSTSYAQKFQGRVTMTRDTSTSTV YMELSSLRSEDTAVYYCASPGMVRGV ITAPLDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2274 | CAGGTCCAGCTGGTACAGTCTGGGG CTGAGGTGAAGAAGCCTGGGGCCTC AGTGAAGGTTTCCTGCAAGGCATCT GGATACACCTTCACCAGCTACTATA TGCACTGGGTGCGACAGGCCCCTGG ACAAGGGCTTGAGTGGATGGGAAT AATCAACCCTAGTGGTGGTAGCACA AGCTACGCACAGAAGTTCCAGGGCA GAGTCACCATGACCAGGGACACGTC CACGAGCACAGTCTACATGGAGCTG AGCAGCCTGAGATCTGAGGACACG GCCGTGTATTACTGTGCGAGCCCGG GTATGGTTCGGGGAGTTATTACTGC CCCGCTTGACTACTGGGGCCAGGGC ACCCTGGTCACCGTCTCCTCAGCAT CCACCAAGGGGCCTTCCGTGTTCCC CCTGGCCCCTTCATCCAAGTCGACC TCTGGTGGAACCGCCGCACTCGGTT GCCTGGTCAAAGACTACTTCCCCGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GCCCGTGACTGTCTCGTGGAACTCG GGCGCCCTCACATCCGGAGTGCATA CCTTTCCCGCCGTGTTGCAGTCCAG CGGCCTGTACAGCCTGAGCTCCGTC GTGACAGTGCCGTCCTCCTCCCTTG GAACCCAGACCTATATCTGCAACGT CAATCACAAGCCCTCCAACACCAAA GTGGACAAGAAGGTCGAACCCAAG TCCTGCGACAAGACTCACACCTGTC CGCCTTGTCCAGCCCCTGAGCTGCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCACG AAGATCCCGAAGTGAAATTCAATTG GTACGTGGATGGGGTCGAAGTGCAC AACGCCAAGACCAAGCCTAGGGAA GAACAGTACgccTCTACGTACCGGGT GGTGTCCGTGCTGACCGTGCTGCAC CAGGACTGGCTGAACGGAAAGGAG TACAAGTGCAAAGTGTCAACAAG GCTCTCCCTGCCCCTATCGAAAAGA CCATCAGCAAGGCCAAGGGTCAACC TAGGGAGCCCCAGGTCTACACTTTG CCGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2167 | EVQLVQSGGGLVKPGGSLRLSCAASG FTFSSYAISWVRQAPGQGLEWMGGIIP MYGTANYAQKFQGRVTITADESTSTA YMELSSLRSEDTALYYCAREAKWGM YYFDYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2275 | GAGGTCCAGCTGGTACAGTCTGGGG GAGGCCTGGTCAAGCCTGGGGGGTC CCTGAGACTCTCCTGTGCAGCCTCT GGATTCACCTTCAGCAGCTATGCTA TCAGCTGGGTGCGACAGGCCCCTGG ACAAGGGCTTGAGTGGATGGGAGG GATCATCCCTATGTATGGTACAGCA AACTACGCACAGAAGTTCCAGGGCA GAGTCACGATTACCGCGGACGAATC CACGAGCACAGCCTACATGGAACTG AGCAGCCTGAGATCTGAGGACACG GCCCTCTATTACTGTGCGAGAGAAG CTAAGTGGGGAATGTACTACTTTGA CTACTGGGGCCAGGGCACCCTGGTC ACCGTCTCCTCAGCATCCACCAAGG GGCCTTCCGTGTTCCCCCTGGCCCCT TCATCCAAGTCGACCTCTGGTGGAA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCCAGAC CTATATCTGCAACGTCAATCACAAG CCCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AAGTGTCAAACAAGGCTCTCCCTGC CCCTATCGAAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA CGTGTTCTCCTGCTCCGTGATGCAC GAAGCGCTGCACAACCATTACACCC AGAAATCACTGTCACTTTCGCCGGG AAAA |
| SEQ ID 2168 | EVQLVESGGGVVQPGRSLRLSCAASGF TFSSYAIHWVRQAPGKGLEWVAIISDD GSKSYYADSVQGRFTISRDNSRNTVYL QMNSLRAEDTAMYYCARDRGTKWNQ LNDVFDMWGQGTMVTVSSASTKGPS VFPLAPSSKSTSGGTAALGCLVKDYFP EPVTVSWNSGALTSGVHTFPAVLQSSG LYSLSSVVTVPSSSLGTQTYICNVNHKP SNTKVDKKVEPKSCDKTHTCPPCPAPE LLGGPSVFLFPPKPKDTLMISRTPEVTC VVVDVSHEDPEVKFNWYVDGVEVHN AKTKPREEQYASTYRVVSVLTVLHQD WLNGKEYKCKVSNKALPAPIEKTISKA KGQPREPQVYTLPPSREEMTKNQVSLT CLVKGFYPSDIAVEWESNGQPENNYK TTPPVLDSDGSFFLYSKLTVDKSRWQQ GNVFSCSVMHEALHNHYTQKSLSLSP GK | SEQ ID 2276 | GAGGTGCAGCTGGTGGAGTCCGGG GGAGGCGTGGTCCAGCCTGGGAGGT CCCTGAGACTCTCCTGTGCAGCCTC TGGATTCACCTTCAGTAGCTATGCT ATACACTGGGTCCGCCAGGCTCCAG GCAAGGGGCTGGAGTGGGTGGCAA TTATATCAGATGATGGAAGTAAGAG TTACTACGCAGACTCCGTGCAGGGC CGATTCACCATCTCCAGAGACAATT CGAGGAACACAGTATATCTGCAAAT GAACAGCCTGAGAGCTGAGGACAC GGCTATGTATTACTGTGCGAGAGAC AGGGGAACTAAATGGAACCAATTG AATGATGTTTTTGATATGTGGGGCC AAGGGACAATGGTCACCGTCTCTTC AGCATCCACCAAGGGGCCTTCCGTG TTCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2169 | QMQLVQSGAEVKKPGASVKVSCTASG YTFTSSDINWVRQATGQGLEWMGWM NPNSGNTGYAEKFQGRVTMTSDSSIST | SEQ ID 2277 | CAGATGCAGCTGGTGCAATCTGGGG CTGAGGTGAAGAAGCCTGGGGCCTC AGTGAAGGTCTCCTGCACGGCTTCT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | AYMELRSLTTEDTAVYYCARGGGASY TDSWGQGTLVTVSSASTKGPSVFPLAP SSKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | | GGATACACCTTCACCAGTTCTGATA TCAACTGGGTGCGACAGGCCACTGG ACAAGGGCTTGAGTGGATGGGATG GATGAACCCTAACAGTGGTAACACC GGCTATGCAGAGAAGTTCCAGGGCA GGGTCACCATGACCAGCGACTCCTC CATAAGCACCGCCTACATGGAGTTG AGAAGCCTGACCACTGAGGACACG GCCGTATATTACTGTGCGAGAGGTG GGGGTGCGAGCTATACTGACTCCTG GGGCCAGGGCACCCTGGTCACCGTC TCCTCAGCATCCACCAAGGGGCCTT CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCGGGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT CTCCTGCTCCGTGATGCACGAAGCG CTGCACAACCATTACACCCAGAAAT CACTGTCACTTTCGCCGGGAAAA |
| SEQ ID 2170 | QVQLVQSGGGLVQPGRSLRLSCTASGF TFGDYAMSWFRQAPGKGLEWVGFIRS KAYGGTTEYAASVKGRFTISRDDSKSI AYLQMNSLKTEDTAVYYCTAKGGYV GYSYGPFGGYWGQGTLVTVSSASTKG PSVFPLAPSSKSTSGGTAALGCLVKDY FPEPVTVSWNSGALTSGVHTFPAVLQS SGLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2278 | CAGGTCCAGCTGGTGCAGTCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACCGCT AAGGGGGGCTACGTCGGATACAGCT ATGGACCTTTTGGGGGCTACTGGGG CCAGGGAACCCTGGTCACCGTCTCC TCAGCATCCACCAAGGGGCCTTCCG TGTTCCCCCTGGCCCCTTCATCCAAG TCGACCTCTGGTGGAACCGCCGCAC TCGGTTGCCTGGTCAAAGACTACTT CCCCGAGCCCGTGACTGTCTCGTGG AACTCGGGCGCCCTCACATCCGGAG TGCATACCTTTCCCGCCGTGTTGCA GTCCAGCGGCCTGTACAGCCTGAGC TCCGTCGTGACAGTGCCGTCCTCCT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCCTTGGAACCCAGACCTATATCTG CAACGTCAATCACAAGCCCTCCAAC ACCAAAGTGGACAAGAAGGTCGAA CCCAAGTCCTGCGACAAGACTCACA CCTGTCCGCCTTGTCCAGCCCCTGA GCTGCTGGGTGGTCCGTCCGTGTTC CTCTTCCCGCCCAAGCCGAAGGACA CTCTGATGATTTCACGCACCCCGGA AGTCACTTGCGTGGTCGTGGACGTG TCGCACGAAGATCCCGAAGTGAAAT TCAATTGGTACGTGGATGGGGTCGA AGTGCACAACGCCAAGACCAAGCCT AGGGAAGAACAGTACgccTCTACGTA CCGGGTGGTGTCCGTGCTGACCGTG CTGCACCAGGACTGGCTGAACGGAA AGGAGTACAAGTGCAAAGTGTCAA ACAAGGCTCTCCCTGCCCCTATCGA AAAGACCATCAGCAAGGCCAAGGG TCAACCTAGGGAGCCCCAGGTCTAC ACTTTGCCGCCTAGCCGGGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC CAAGCTGACTGTGGACAAGTCAAGA TGGCAGCAGGGAAACGTGTTCTCCT GCTCCGTGATGCACGAAGCGCTGCA CAACCATTACACCCAGAAATCACTG TCACTTTCGCCGGGAAAA |
| SEQ ID 2171 | QVQLVQSGGGLVQPGRSLRLSCTASGF TFGDYAMSWFRQAPGKGLEWVGFIRS KAYGGTTEYAASVKGRFTISRDDSKSI AYLQMNSLKTEDTAVYYCTRGGTMV RGFGFNYWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2279 | CAGGTGCAGCTGGTGCAGTCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCA AATGAACAGCCTGAAAACCGAGGA CACAGCCGTGTATTACTGTACTAGA GGGGGGACTATGGTTCGGGGTTTCG GATTTAACTACTGGGGCCAGGGAAC CCTGGTCACCGTCTCCTCAGCATCC ACCAAGGGGCCTTCCGTGTTCCCCC TGGCCCCTTCATCCAAGTCGACCTC TGGTGGAACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCCAGACCTATATCTGAACGTCA ATCACAAGCCCTCCAACACCAAAGT GGACAAGAAGGTCGAACCCAAGTC CTGCGACAAGACTCACACCTGTCCG CCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCACGAA GATCCCGAAGTGAAATTCAATTGGT ACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AGAACCAAGTGTCCCTGACTTGCCT
TGTCAAGGGCTTTTATCGTCCGAC
ATCGCCGTGGAGTGGGAGTCCAACG
GACAACCGGAGAACAACTACAAGA
CCACCCCACCGGTGCTCGATTCCGA
TGGCTCCTTCTTCCTGTACTCCAAGC
TGACTGTGGACAAGTCAAGATGGCA
GCAGGGAAACGTGTTCTCCTGCTCC
GTGATGCACGAAGCGCTGCACAACC
ATTACACCCAGAAATCACTGTCACT
TTCGCCGGGAAAA |
| SEQ ID 2172 | QVQLQQWGAGLLKPSETLSLTCAVYG
GSFSGYYWSWIRQPPGKGLEWIGEINH
SGSTNYNPSLKSRVTISVDTSKNQFSLK
LSSVTAADTAVYYCARARRAMIGPLP
RLVGYFDLWGRGTLVTVSSASTKGPS
VFPLAPSSKSTSGGTAALGCLVKDYFP
EPVTVSWNSGALTSGVHTFPAVLQSSG
LYSLSSVVTVPSSSLGTQTYICNVNHKP
SNTKVDKKVEPKSCDKTHTCPPCPAPE
LLGGPSVFLFPPKPKDTLMISRTPEVTC
VVVDVSHEDPEVKFNWYVDGVEVHN
AKTKPREEQYASTYRVVSVLTVLHQD
WLNGKEYKCKVSNKALPAPIEKTISKA
KGQPREPQVYTLPPSREEMTKNQVSLT
CLVKGFYPSDIAVEWESNGQPENNYK
TTPPVLDSDGSFFLYSKLTVDKSRWQQ
GNVFSCSVMHEALHNHYTQKSLSLSP
GK | SEQ ID 2280 | CAGGTGCAGCTACAGCAGTGGGGC
GCAGGACTGTTGAAGCCTTCGGAGA
CCCTGTCCCTCACCTGCGCTGTCTAT
GGTGGGTCCTTCAGTGGTTACTACT
GGAGCTGGATCCGCCAGCCCCCAGG
GAAGGGGCTGGAGTGGGATTGGGGA
AATCAATCATAGTGGAAGCACCAAC
TACAACCCGTCCCTCAAGAGTCGAG
TCACCATATCAGTAGACACGTCCAA
GAACCAGTTCTCCCTGAAGCTGAGC
TCTGTGACCGCCGCGGACACGGCTG
TGTATTACTGTGCGAGAGCCCGGCG
GGCTATGATAGGGCCGCTTCCGCGA
CTTGTCGGGTACTTCGATCTCTGGG
GCCGTGGAACCCTGGTCACCGTCTC
CTCAGCATCCACCAAGGGGCCTTCC
GTGTTCCCCCTGGCCCCTTCATCCAA
GTCGACCTCTGGTGGAACCGCCGCA
CTCGGTTGCCTGGTCAAAGACTACT
TCCCCGAGCCCGTGACTGTCTCGTG
GAACTCGGGCGCCCTCACATCCGGA
GTGCATACCTTTCCCGCCGTGTTGC
AGTCCAGCGGCCTGTACAGCCTGAG
CTCCGTCGTGACAGTGCCGTCCTCC
TCCCTTGGAACCCAGACCTATATCT
GCAACGTCAATCACAAGCCCTCCAA
CACCAAAGTGGACAAGAAGGTCGA
ACCCAAGTCCTGCGACAAGACTCAC
ACCTGTCCGCCTTGTCCAGCCCCTG
AGCTGCTGGGTGGTCCGTCCGTGTT
CCTCTTCCCGCCCAAGCCGAAGGAC
ACTCTGATGATTTCACGCACCCCGG
AAGTCACTTGCGTGGTCGTGGACGT
GTCGCACGAAGATCCCGAAGTGAA
ATTCAATTGGTACGTGGATGGGGTC
GAAGTGCACAACGCCAAGACCAAG
CCTAGGGAAGAACAGTACgccTCTAC
GTACCGGGTGGTGTCCGTGCTGACC
GTGCTGCACCAGGACTGGCTGAACG
GAAAGGAGTACAAGTGCAAAGTGT
CAAACAAGGCTCTCCCTGCCCCTAT
CGAAAAGACCATCAGCAAGGCCAA
GGGTCAACCTAGGGAGCCCCAGGTC
TACACTTTGCCGCCTAGCCGGGAAG
AAATGACTAAGAACCAAGTGTCCCT
GACTTGCCTTGTCAAGGGCTTTTATC
CGTCCGACATCGCCGTGGAGTGGGA
GTCCAACGGACAACCGGAGAACAA
CTACAAGACCACCCCACCGGTGCTC
GATTCCGATGGCTCCTTCTTCCTGTA
CTCCAAGCTGACTGTGGACAAGTCA
AGATGGCAGCAGGGAAACGTGTTCT
CCTGCTCCGTGATGCACGAAGCGCT
GCACAACCATTACACCCAGAAATCA
CTGTCACTTTCGCCGGGAAAA |
| SEQ ID 2173 | QVQLQQWGAGLLKPSETLSLTCAVYG
GSFSGYYWSWIRQPPGKGLEWIGEINH
SGSTNYNPSLKSRVTISVDTSKNQFSLK
LSSVTAADTAVYYCARGRPAPSWVKT
RNWFDPWGQGTLVTVSSASTKGPSVF
PLAPSSKSTSGGTAALGCLVKDYFPEP
VTVSWNSGALTSGVHTFPAVLQSSGL
YSLSSVVTVPSSSLGTQTYICNVNHKPS | SEQ ID 2281 | CAGGTGCAGCTACAGCAGTGGGGC
GCAGGACTGTTGAAGCCTTCGGAGA
CCCTGTCCCTCACCTGCGCTGTCTAT
GGTGGGTCCTTCAGTGGTTACTACT
GGAGCTGGATCCGCCAGCCCCCAGG
GAAGGGGCTGGAGTGGATTGGGA
AATCAATCATAGTGGAAGCACCAAC
TACAACCCGTCCCTCAAGAGTCGAG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | | TCACCATATCAGTAGACACGTCCAA GAACCAGTTCTCCCTGAAGCTGAGC TCTGTGACCGCCGCGGACACGGCTG TGTATTACTGTGCGAGAGGCCGCCC CGCCCCATCCTGGGTTAAAACCCGT AACTGGTTCGACCCCTGGGGCCAGG GAACCCTGGTCACCGTCTCCTCAGC ATCCACCAAGGGGCCTTCCGTGTTC CCCCTGGCCCCTTCATCCAAGTCGA CCTCTGGTGGAACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2174 | QVQLQQSGPGLVKPSQTLSLTCAISGD SVSSNSAAWNWIRQSPSRGLEWLGRT YYRSKWYNDYAVSVKSRITINPDTSKN QFSLQLNSVTPEDTAVYYCAREASSG WNWGQGTLVTVSSASTKGPSVFPLAP SSKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2282 | CAGGTACAGCTGCAGCAGTCAGGTC CAGGACTGGTGAAGCCCTCGCAGAC CCTCTCACTCACCTGTGCCATCTCCG GGGACAGTGTCTCTAGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGGCTGTGTATTACTGTGCAA GAGAGGCTAGCAGTGGCTGGAACT GGGGCCAGGGAACCCTGGTCACCGT CTCCTCAGCCATCCACCAAGGGCCT TCCGTGTTCCCCCTGGCCCCTTCATC CAAGTCGACCTCTGGTGGAACCGCC GCACTCGGTTGCCTGGTCAAAGACT ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCCAGACCTATA TCTGCAACGTCAATCACAAGCCCTC CAACACCAAAGTGGACAAGAAGGT CGAACCCAAGTCCTGCGACAAGACT CACACCTGTCCGCCTTGTCCAGCCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CTGAGCTGCTGGGTGGTCCGTCCGT
GTTCCTCTTCCCGCCCAAGCCGAAG
GACACTCTGATGATTTCACGCACCC
CGGAAGTCACTTGCGTGGTCGTGGA
CGTGTCGCACGAAGATCCCGAAGTG
AAATTCAATTGGTACGTGGATGGGG
TCGAAGTGCACAACGCCAAGACCA
AGCCTAGGGAAGAACAGTACgccTCT
ACGTACCGGGTGGTGTCCGTGCTGA
CCGTGCTGCACCAGGACTGGCTGAA
CGGAAAGGAGTACAAGTGCAAAGT
GTCAAACAAGGCTCTCCCTGCCCCT
ATCGAAAAGACCATCAGCAAGGCC
AAGGGTCAACCTAGGGAGCCCCAG
GTCTACACTTTGCCGCCTAGCCGGG
AAGAAAATGACTAAGAACCAAGTGT
CCCTGACTTGCCTTGTCAAGGGCTTT
TATCCGTCCGACATCGCCGTGGAGT
GGGAGTCCAACGGACAACCGGAGA
ACAACTACAAGACCACCCCACCGGT
GCTCGATTCCGATGGCTCCTTCTTCC
TGTACTCCAAGCTGACTGTGGACAA
GTCAAGATGGCAGCAGGGAAACGT
GTTCTCCTGCTCCGTGATGCACGAA
GCGCTGCACAACCATTACACCCAGA
AATCACTGTCACTTTCGCCGGGAAA
A |
| SEQ ID 2175 | QVQLQESGPGLVKPSQTLSLTCAISGD
SVSSNNAAWNWIRQSPSRGLEWLGRT
FYRSKWYNDYAVSVKSRLTVNPDTSK
NQFSLRLNSVSPEDTAVYYCARGGRY
TKGGYFDDWGQGTLVTVSSASTKGPS
VFPLAPSSKSTSGGTAALGCLVKDYFP
EPVTVSWNSGALTSGVHTFPAVLQSSG
LYSLSSVVTVPSSSLGTQTYICNVNHKP
SNTKVDKKVEPKSCDKTHTCPPCPAPE
LLGGPSVFLFPPKPKDTLMISRTPEVTC
VVVDVSHEDPEVKFNWYVDGVEVHN
AKTKPREEQYASTYRVVSVLTVLHQD
WLNGKEYKCKVSNKALPAPIEKTISKA
KGQPREPQVYTLPPSREEMTKNQVSLT
CLVKGFYPSDIAVEWESNGQPENNYK
TTPPVLDSDGSFFLYSKLTVDKSRWQQ
GNVFSCSVMHEALHNHYTQKSLSLSP
GK | SEQ ID 2283 | CAGGTGCAGCTGCAGGAGTCCGGTC
CAGGACTGGTGAAGCCCTCGCAGAC
CCTCTCACTCACCTGTGCCATCTCCG
GGGACAGTGTCTCTAGCAACAATGC
TGCCTTGGAACTGGATCAGGCAGTCC
CCATCGAGAGGCCTTGAGTGGCTGG
GAAGGACATTCTACAGGTCCAAGTG
GTATAATGACTATGCAGTTTCTGTG
AAAAAGTCGACTAACCGTCAACCCAG
ACACATCCAAGAACCAGTTCTCCCT
GCGGTTGAACTCTGTGAGTCCCGAG
GACACGGCTGTGTATTACTGTGCAA
GAGGGGGAAGATATACCAAGGGAG
GGTACTTTGACGACTGGGGCCAGGG
AACCCTGGTGACCGTCTCCTCAGCA
TCCACCAAGGGGCCTTCCGTGTTCC
CCCTGGCCCCTTCATCCAAGTCGAC
CTCTGGTGGAACCGCCGCACTCGGT
TGCCTGGTCAAGACTACTTCCCCG
AGCCCGTGACTGTCTCGTGGAACTC
GGGCGCCCTCACATCCGGAGTGCAT
ACCTTTCCCGCCGTGTTGCAGTCCA
GCGGCCTGTACAGCCTGAGCTCCGT
CGTGACAGTGCCGTCCTCCTCCCTT
GGAACCCAGACCTATATCTGCAACG
TCAATCACAAGCCCTCCAACACCAA
AGTGGACAAGAAGGTCGAACCCAA
GTCCTGCGACAAGACTCACACCTGT
CCGCCTTGTCCAGCCCCTGAGCTGC
TGGGTGGTCCGTCCGTGTTCCTCTTC
CCGCCCAAGCCGAAGGACACTCTGA
TGATTTCACGCACCCCGGAAGTCAC
TTGCGTGGTCGTGGACGTGTCGCAC
GAAGATCCCGAAGTGAAATTCAATT
GGTACGTGGATGGGTCGAAGTGCA
CAACGCCAAGACCAAGCCTAGGGA
AGAACAGTACgccTCTACGTACCGGG
TGGTGTCCGTGCTGACCGTGCTGCA
CCAGGACTGGCTGAACGGAAAGGA
GTACAAGTGCAAAGTGTCAAACAA
GGCTCTCCCTGCCCCTATCGAAAAG
ACCATCAGCAAGGCCAAGGGTCAA
CCTAGGGAGCCCCAGGTCTACACTT
TGCCGCCTAGCCGGGAAGAAAATGAC
TAAGAACCAAGTGTCCCTGACTTGC
CTTGTCAAGGGCTTTTATCCGTCCG
ACATCGCCGTGGAGTGGGAGTCCAA
CGGACAACCGGAGAACAACTACAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2176 | QVTLKESGPTLVKPTQTLTLTCTFSGFS LSTSGVGVGWIRQPPGKALEWLALIY WDDDKRYSPSLKSRLTITKDTSKNQV VLTMTNMDPVDTATYYCAHRLDSSGR GGYFDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2284 | CAGGTCACCTTGAAGGAGTCTGGTC CTACGCTGGTGAAACCCACACAGAC CCTCACGCTGACCTGCACCTTCTCTG GGTTCTCACTCAGCACTAGTGGAGT GGGTGGGCTGGATCCGTCAGCCC CCAGGAAAGGCCCTGGAGTGGCTTG CACTCATTTATTGGGATGATGATAA GCGCTACAGCCCATCTCTGAAGAGC AGGCTCACCATCACCAAGGACACCT CCAAAACCAGGTGGTCCTTACAAT GACCAACATGGACCCTGTGGACACA GCCACATATTACTGTGCACACAGAT TGGATAGCAGTGGCCGTGGTGGTTA CTTTGACTACTGGGGCCAGGGCACC CTGGTCACCGTCTCCTCAGCATCCA CCAAGGGGCCTTCCGTGTTCCCCCT GGCCCCTTCATCCAAGTCGACCTCT GGTGGAACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCCAGACCTATATCTGCAACGTCAA TCACAAGCCCTCCAACACCAAAGTG GACAAGAAGGTCGAACCCAAGTCCT GCGACAAGACTCACACCTGTCCGCC TTGTCCAGCCCCTGAGCTGCTGGGT GGTCCGTCCGTGTTCCTCTTCCCGCC CAAGCCGAAGGACACTCTGATGATT TCACGCACCCCGGAAGTCACTTGCG TGGTCGTGGACGTGTCGCACGAAGA TCCCGAAGTGAAATTCAATTGGTAC GTGGATGGGGTCGAAGTGCACAAC GCCAAGACCAAGCCTAGGGAAGAA CAGTACgccTCTACGTACCGGGTGGT GTCCGTGCTGACCGTGCTGCACCAG GACTGGCTGAACGGAAAGGAGTAC AAGTGCAAAGTGTCAAACAAGGCTC TCCCTGCCCCTATCGAAAAGACCAT CAGCAAGGCCAAGGGTCAACCTAG GGAGCCCCAGGTCTACACTTTTGCCG CCTAGCCGGGAAGAAATGACTAAG AACCAAGTGTCCCTGACTTGCCTTG TCAAGGGCTTTTATCCGTCCGACAT CGCCGTGGAGTGGGAGTCCAACGG ACAACGGAGAACAACTACAAGAC CACCCCACCGGTGCTCGATTCCGAT GGCTCCTTCTTCCTGTACTCCAAGCT GACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2177 | EVQLVESGGGVVQPGRSLRLSCTASGF TFSSYGMHWVRQAPGKGLEWVAVISY DGSNKYYADSVKGRFTISRDNSKNTL YLQMNSLRAEDTAVYYCAKELVGTSS PYYYYYYGMDVWGQGTMVTVSSAST KGPSVFPLAPSSKSTSGGTAALGCLVK DYFPEPVTVSWNSGALTSGVHTFPAVL QSSGLYSLSSVVTVPSSSLGTQTYICNV NHKPSNTKVDKKVEPKSCDKTHTCPP CPAPELLGGPSVFLFPPKPKDTLMISRT PEVTCVVVDVSHEDPEVKFNWYVDG VEVHNAKTKPREEQYASTYRVVSVLT | SEQ ID 2285 | GAGGTGCAGCTGGTGGAGTCTGGGG GAGGCGTGGTCCAGCCTGGGAGGT CCTGAGACTCTCCTGTACAGCCTCT GGATTCACCTTCAGTAGCTATGGCA TGCACTGGGTCCGCCAGGCTCCAGG CAAGGGGCTGGAGTGGGTGGCAGTT ATATCATATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAAGAGTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | VLHQDWLNGKEYKCKVSNKALPAPIE KTISKAKGQPREPQVYTLPPSREEMTK NQVSLTCLVKGFYPSDIAVEWESNGQP ENNYKTTPPVLDSDGSFFLYSKLTVDK SRWQQGNVFSCSVMHEALHNHYTQK SLSLSPGK | | GGTGGGTACCAGCTCTCCTTATTAC TACTACTACTACGGTATGGACGTCT GGGGGCCAAGGGACAATGGTCACCG TCTCTTCAGCATCCACCAAGGGGCC TTCCGTGTTCCCCCTGGCCCCTTCAT CCAAGTCGACCTCTGGTGGAACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCCAGACCTAT ATCTGCAACGTCAATCACAAGCCCT CCAACACCAAAGTGGACAAGAAGG TCGAACCCAAGTCCTGCGACAAGAC TCACACCTGTCCGCCTTGTCCAGCC CCTGAGCTGCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCACGAAGATCCCGAAGT GAAATTCAATTGGTACGTGGATGGG GTCGAAGTGCACAACGCCAAGACC AAGCCTAGGGAAGAACAGTACgccT CTACGTACCGGGTGGTGTCCGTGCT GACCGTGCTGCACCAGGACTGGCTG AACGGAAAGGAGTACAAGTGCAAA GTGTCAAACAAGGCTCTCCCTGCCC CTATCGAAAAGACCATCAGCAAGGC CAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2178 | QLQLQESGGGLVQPGGSLRLSCAASGF TVSSNYMSWVRQAPGKGLEWVSVIYS GGSTYYADSVKGRFTISRDNSKNTLYL QMNSLRAEDTAVYYCARDYYYGSGSS PWGQGTLVTVSSASTKGPSVFPLAPSS KSTSGGTAALGCLVKDYFPEPVTVSW NSGALTSGVHTFPAVLQSSGLYSLSSV VTVPSSSLGTQTYICNVNHKPSNTKVD KKVEPKSCDKTHTCPPCPAPELLGGPS VFLFPPKPKDTLMISRTPEVTCVVVDV SHEDPEVKFNWYVDGVEVHNAKTKP REEQYASTYRVVSVLTVLHQDWLNGK EYKCKVSNKALPAPIEKTISKAKGQPR EPQVYTLPPSREEMTKNQVSLTCLVKG FYPSDIAVEWESNGQPENNYKTTPPVL DSDGSFFLYSKLTVDKSRWQQGNVFS CSVMHEALHNHYTQKSLSLSPGK | SEQ ID 2286 | CAGCTGCAGCTGCAGGAGTCGGGG GGAGGCTTGGTCCAGCCTGGGGGGT CCCTGAGACTCTCCTGTGCAGCCTC TGGATTCACCGTCAGTAGCAACTAC ATGAGCTGGGTCCGCCAGGCTCCAG GGAAGGGGCTGGAGTGGGTCTCAGT TATTTATAGCGGTGGTAGCACATAC TACGCAGACTCCGTGAAGGGCAGAT TCACCATCTCCAGAGACAATTCCAA GAACACGCTGTATCTTCAAATGAAC AGCCTGAGAGCCGAGGACACGGCT GTGTATTACTGTGCGAGAGACTATT ACTATGGTTCGGGGAGTTCTCCCTG GGGCCAGGGAACCCTGGTCACCGTC TCCTCAGCATCCACCAAGGGCCTT CCGTGTTCCCCCTGGCCCCTTCATCC AAGTCGACCTCTGGTGGAACCGCC CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCCGGGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT CTCCTGCTCCGTGATGCACGAAGCG CTGCACAACCATTACACCCAGAAAT CACTGTCACTTTCGCCGGGAAAA |
| SEQ ID 2179 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGRPYCSSTSCY PEWFDPWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIA VEWESNGQPENNYKTTPP VLDSDGSFFLYSKLTVDKSRWQQGNV FSCSVMHEALHNHYTQKSLSLSPGK | SEQ ID 2287 | CAGGTGCAGCTACAGCAGTGGGGC GCAGGACTGTTGAAGCCTTCGGAGA CCCTGTCCCTCACCTGCGCTGTCTAT GGTGGGTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAGGCCGGCC ATATTGTAGTAGTACCAGCTGCTAC CCAGAGTGGTTCGACCCCTGGGGCC AGGGAACCCTGGTCACCGTCTCCTC AGCATCCACCAAGGGGCCTTCCGTG TTCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TCCGTGATGCACGAAGCGCTGCACA<br>ACCATTACACCCAGAAATCACTGTC<br>ACTTTCGCCGGGAAAA |
| SEQ ID<br>2180 | QVTLKESGGGVVQPGRSLRLSCAASGF<br>TFSSYGMHWVRQAPGKGLEWVAVISY<br>DGSNKYYADSVKGRFTISRDNSKNTL<br>YLQMNSLRAEDTAVYYCAKLRGIDYY<br>DSSGYQRGFDYWGQGTLVTVSSASTK<br>GPSVFPLAPSSKSTSGGTAALGCLVKD<br>YFPEPVTVSWNSGALTSGVHTFPAVLQ<br>SSGLYSLSSVVTVPSSSLGTQTYICNVN<br>HKPSNTKVDKKVEPKSCDKTHTCPPCP<br>APELLGGPSVFLFPPKPKDTLMISRTPE<br>VTCVVVDVSHEDPEVKFNWYVDGVE<br>VHNAKTKPREEQYASTYRVVSVLTVL<br>HQDWLNGKEYKCKVSNKALPAPIEKT<br>ISKAKGQPREPQVYTLPPSREEMTKNQ<br>VSLTCLVKGFYPSDIAVEWESNGQPEN<br>NYKTTPPVLDSDGSFFLYSKLTVDKSR<br>WQQGNVFSCSVMHEALHNHYTQKSL<br>SLSPGK | SEQ ID<br>2288 | CAGGTCACCTTGAAGGAGTCTGGGG<br>GAGGCGTGGTCCAGCCTGGGAGGTC<br>CCTGAGACTCTCCTGTGCAGCCTCT<br>GGATTCACCTTCAGTAGCTATGGCA<br>TGCACTGGGTCCGCCAGGCTCCAGG<br>CAAGGGGCTGGAGTGGGTGGCAGTT<br>ATATCATATGATGGAAGTAATAAAT<br>ACTATGCAGACTCCGTGAAGGGCCG<br>ATTCACCATCTCCAGAGACAATTCC<br>AAGAACACGCTGTATCTGCAAATGA<br>ACAGCCTGAGAGCTGAGGACACGG<br>CTGTGTATTACTGTGCGAAATTAAG<br>GGGTATAGATTACTATGATAGTAGT<br>GGTTACCAACGGGGGTTTGACTACT<br>GGGGCCAGGGAACCCTGGTCACCGT<br>CTCCTCAGCATCCACCAAGGGGCCT<br>TCCGTGTTCCCCCTGGCCCCTTCATC<br>CAAGTCGACCTCTGGTGGAACCGCC<br>GCACTCGGTTGCCTGGTCAAAGACT<br>ACTTCCCCGAGCCCGTGACTGTCTC<br>GTGGAACTCGGGCGCCCTCACATCC<br>GGAGTGCATACCTTTCCCGCCGTGT<br>TGCAGTCCAGCGGCCTGTACAGCCT<br>GAGCTCCGTCGTGACAGTGCCGTCC<br>TCCTCCCTTGGAACCCAGACCTATA<br>TCTGCAACGTCAATCACAAGCCCTC<br>CAACACCAAAGTGGACAAGAAGGT<br>CGAACCCAAGTCCTGCGACAAGACT<br>CACACCTGTCCGCCTTGTCCAGCCC<br>CTGAGCTGCTGGGTGGTCCGTCCGT<br>GTTCCTCTTCCCGCCCAAGCCGAAG<br>GACACTCTGATGATTTCACGCACCC<br>CGGAAGTCACTTGCGTGGTCGTGGA<br>CGTGTCGCACGAAGATCCCGAAGTG<br>AAATTCAATTGGTACGTGGATGGGG<br>TCGAAGTGCACAACGCCAAGACCA<br>AGCCTAGGGAAGAACAGTACgccTCT<br>ACGTACCGGGTGGTGTCCGTGCTGA<br>CCGTGCTGCACCAGGACTGGCTGAA<br>CGGAAAGGAGTACAAGTGCAAAGT<br>GTCAAACAAGGCTCTCCCTGCCCCT<br>ATCGAAAAGACCATCAGCAAGGCC<br>AAGGGTCAACCTAGGGAGCCCCAG<br>GTCTACACTTTGCCGCCTAGCCGGG<br>AAGAAATGACTAAGAACCAAGTGT<br>CCCTGACTTGCCTTGTCAAGGGCTTT<br>TATCCGTCCGACATCGCCGTGGAGT<br>GGGAGTCCAACGGACAACCGGAGA<br>ACAACTACAAGACCACCCCACCGGT<br>GCTCGATTCCGATGGCTCCTTCTTCC<br>TGTACTCCAAGCTGACTGTGGACAA<br>GTCAAGATGGCAGCAGGGAAACGT<br>GTTCTCCTGCTCCGTGATGCACGAA<br>GCGCTGCACAACCATTACACCCAGA<br>AATCACTGTCACTTTCGCCGGGAAA<br>A |
| SEQ ID<br>2181 | QVQLQESGPGLVKPSETLSLTCTVSGG<br>SISSYYWSWIRQPPGKGLEWIGYIYYT<br>GSTNYNPSLKSRVTISVDTSKNQFSLKL<br>SSVTTADTAVYYCARGGRGDGAAFDI<br>WGQGTMVTVSSASTKGPSVFPLAPSSK<br>STSGGTAALGCLVKDYFPEPVTVSWN<br>SGALTSGVHTFPAVLQSSGLYSLSSVV<br>TVPSSSLGTQTYICNVNHKPSNTKVDK<br>KVEPKSCDKTHTCPPCPAPELLGGPSV<br>FLFPPKPKDTLMISRTPEVTCVVVDVS<br>HEDPEVKFNWYVDGVEVHNAKTKPR<br>EEQYASTYRVVSVLTVLHQDWLNGKE<br>YKCKVSNKALPAPIEKTISKAKGQPRE<br>PQVYTLPPSREEMTKNQVSLTCLVKGF<br>YPSDIAVEWESNGQPENNYKTTPPVLD | SEQ ID<br>2289 | CAGGTGCAGCTGCAGGAGTCCGGCC<br>CAGGACTGGTGAAGCCTTCGGAGAC<br>CCTGTCCCTCACCTGCACTGTCTCTG<br>GTGGCTCCATCAGTAGTTACTACTG<br>GAGCTGGATCCGGCAGCCCCCAGGG<br>AAGGGACTGGAGTGGATTGGCTATA<br>TCTATTACACTGGGAGCACCAACTA<br>CAACCCCTCCCTCAAGAGCCGAGTC<br>ACCATATCAGTAGACACGTCCAAGA<br>ACCAGTTCTCCCTGAAGCTGAGCTC<br>TGTGACCACTGCGGACACGGCCGTG<br>TATTACTGTGCGAGAGGTGGGAGGG<br>GGGATGGGGCCGCTTTTGACATCTG<br>GGGCCAAGGGACAATGGTCACCGTC<br>TCTTCAGCATCCACCAAGGGGCCTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | SDGSFFLYSKLTVDKSRWQQGNVFSCS VMHEALHNHYTQKSLSLSPGK | | CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCCGGGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT CTCCTGCTCCGTGATGCACGAAGCG CTGCACAACCATTACACCCAGAAAT CACTGTCACTTTCGCCGGGAAAA |
| SEQ ID 2182 | QVQLVQSGGGVVQPGRSLRLSCAASG FTFSSSAMHWVRQAPGKGLEWVAMI WHDESKKYYADSVKGRFTISRDNSKN TLYLQMNSLRAEDTAVYYCARPPDGG NSGRWYFDLWGRGTLVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2290 | CAGGTGCAGCTGGTGCAATCTGGGG GAGGCGTGGTCCAGCCTGGGAGGTC CCTGAGACTCTCCTGTGCAGCGTCT GGATTCACCTTCAGCAGCTCTGCCA TGCACTGGGTCCGCCAGGCTCCAGG CAAGGGACTGGAGTGGGTGGCAAT GATTTGGCATGATGAGAGTAAGAAA TACTATGCAGACTCCGTGAAGGGCC GATTCACTATCTCCAGAGACAATTC CAAGAACACGCTGTATCTGCAAATG AACAGCCTGAGAGCTGAGGACACG GCTGTGTATTACTGTGCGAGACCCC CCGACGGTGGTAACTCCGGTCGCTG GTACTTCGATCTCTGGGGCCGTGGC ACCCTGGTCACCGTCTCCTCAGCAT CCACCAAGGGGCCTTCCGTGTTCCC CCTGGCCCCTTCATCCAAGTCGACC TCTGGTGGAACCGCCGCACTCGGTT GCCTGGTCAAAGACTACTTCCCCGA GCCCGTGACTGTCTCGTGGAACTCG GGCGCCCTCACATCCGGAGTGCATA CCTTTCCCGCCGTGTTGCAGTCCAG CGGCCTGTACAGCCTGAGCTCCGTC GTGACAGTGCCGTCCTCCTCCCTTG GAACCCAGACCTATATCTGCAACGT CAATCACAAGCCCTCCAACACCAAA GTGGACAAGAAGGTCGAACCCAAG TCCTGCGACAAGACTCACACCTGTC CGCCTTGTCCAGCCCCTGAGCTGCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCACG AAGATCCCGAAGTGAAATTCAATTG GTACGTGGATGGGGTCGAAGTGCAC AACGCCAAGACCAAGCCTAGGGAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GAACAGTACgccTCTACGTACCGGGT GGTGTCCGTGCTGACCGTGCTGCAC CAGGACTGGCTGAACGGAAAGGAG TACAAGTGCAAAGTGTCAAACAAG GCTCTCCCTGCCCCTATCGAAAAGA CCATCAGCAAGGCCAAGGGTCAACC TAGGGAGCCCCAGGTCTACACTTTG CCGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2183 | QMQLVQSGGGLVQPGGSLRLSCAASG FTFSSYAMSWVRQAPGKGLEWVSAIS GSGGSTYYADSVKGRFTISRDNSKNTL YLQMNSLRAEDTAVYYCAKDKNVRK HDYGDHPYGGYFDYWGQGTLVTSS ASTKGPSVFPLAPSSKSTSGGTAALGC LVKDYFPEPVTVSWNSGALTSGVHTFP AVLQSSGLYSLSSVVTVPSSSLGTQTYI CNVNHKPSNTKVDKKVEPKSCDKTHT CPPCPAPELLGGPSVFLFPPKPKDTLMI SRTPEVTCVVVDVSHEDPEVKFNWYV DGVEVHNAKTKPREEQYASTYRVVSV LTVLHQDWLNGKEYKCKVSNKALPAP IEKTISKAKGQPREPQVYTLPPSREEMT KNQVSLTCLVKGFYPSDIAVEWESNG QPENNYKTTPPVLDSDGSFFLYSKLTV DKSRWQQGNVFSCSVMHEALHNHYT QKSLSLSPGK | SEQ ID 2291 | CAGATGCAGCTGGTGCAATCTGGGG GAGGCTTGGTACAGCCTGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGACAA GAACGTCCGAAAACATGACTACGGT GACCACCCCTACGGGGGGTACTTTG ACTACTGGGGCCAGGGCACCCTGGT GACCGTCTCCTCAGCATCCACCAAG GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCAAGCTGACTG TGGACAAGTCAAGATGGCAGCAGG GAAACGTGTTCTCCTGCTCCGTGAT GCACGAAGCGCTGCACAACCATTAC ACCCAGAAATCACTGTCACTTTCGC CGGGAAAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| SEQ ID 2184 | EVQLVQSGAEVKKPGASVKVSCKASG YTFTSYAMHWVRQAPGQRLEWMGWI NAGNGNTKYSQKFQGRVTITRDTSAST AYMELSSLRSEDTAVYYCARVAGATS LWYWGQGTLVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2292 | GAGGTCCAGCTGGTACAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATTACCAGGGACACATC CGCGAGCACAGCCTACATGGAGCTG AGCAGCCTGAGATCTGAAGACACG GCTGTGTATTACTGTGCGAGAGTGG CGGGAGCTACTTCCCTATGGTACTG GGGCCAGGGCACCCTGGTCACCGTC TCCTCAGCATCCACCAAGGGGCCTT CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCCGGGAA GAAATGACTAAGAACCAAGTGTCCC TGACTTGCCTTGTCAAGGGCTTTTAT CCGTCCGACATCGCCGTGGAGTGGG AGTCCAACGGACAACGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT CTCCTGCTCCGTGATGCACGAAGCG CTGCACAACCATTACACCCAGAAAT CACTGTCACTTTCGCCGGGAAAA |
| SEQ ID 2185 | QVQLQQSGPGLVKPSQSLSLTCAISGD SVSSNSAAWNWIRQSPSRGLEWLGRT YYRSKWYNDYAVSVKSRITIKPDTSKN QFSLQLNSVTPEDTAVYYCTRLANSDG VDVWGQGTMVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2293 | CAGGTACAGCTGCAGCAGTCAGGTC CAGGACTGGTGAAGCCCTCGCAGAG CCTCTCACTCACCTGTGCCATCTCCG GGGACAGTGTCTCTAGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAGAGTCGAATAACCATCAAACCA GACACATCCAAGAACCAGTTCTCCC TGCAGCTGAACTCTGTGACTCCCGA GGACACGGCTGTGTATTACTGTACA AGGCTAGCTAATTCCGACGGTGTGG ACGTCTGGGGCCAAGGGACAATGGT CACCGTCTCCTCAGCATCCACCAAG GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCAAGCTGACTG TGGACAAGTCAAGATGGCAGCAGG GAAACGTGTTCTCCTGCTCCGTGAT GCACGAAGCGCTGCACAACCATTAC ACCCAGAAATCACTGTCACTTTCGC CGGGAAAA |
| SEQ ID 2186 | QVQLQQSGPGLVKPSQTLSLTCAISGD SVSSDSAVWTWIRQSPSRGLEWLGRT YYKSKWYNDYAASVKSRITINPDTSK NQFSLHLNSVTPEDTAVYYCARGVTR TFDYWGQGTTVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2294 | CAGGTACAGCTGCAGCAGTCAGGTC CAGGACTGGTGAAGCCCTCGCAGAC CCTCTCACTCACCTGTGCCATCTCCG GGGACAGTGTCTCTAGCGACAGTGC TGTTTGGACCTGGATCAGGCAGTCC CCATCGAGAGGCCTTGAGTGGCTGG GAAGGACATACTACAAGTCGAAGT GGTATAATGATTATGCAGCATCTGT GAAAAGTCGAATAACCATCAACCCA GACACATCCAAGAACCAGTTCTCCC TGCACCTGAACTCTGTGACTCCCGA GGACACGGCTGTGTATTACTGTGCA AGAGGTGTAACCCGGACCTTTGACT ACTGGGGCCAGGGGACCACGGTCA CCGTCTCCTCAGCATCCACCAAGGG GCCTTCCGTGTTCCCCCTGGCCCCTT CATCCAAGTCGACCTCTGGTGGAAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCCGCC GTGTTGCAGTCCAGCGGCCTGTACA GCCTGAGCTCCGTCGTGACAGTGCC GTCCTCCTCCCTTGGAACCCAGACC TATATCTGCAACGTCAATCACAAGC CCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCCTATCGAAAAGACCATCAGCAAG<br>GCCAAGGGTCAACCTAGGGAGCCCC<br>AGGTCTACACTTTGCCGCCTAGCCG<br>GGAAGAAATGACTAAGAACCAAGT<br>GTCCCTGACTTGCCTTGTCAAGGGC<br>TTTTATCCGTCCGACATCGCCGTGG<br>AGTGGGAGTCCAACGGACAACCGG<br>AGAACAACTACAAGACCACCCCACC<br>GGTGCTCGATTCCGATGGCTCCTTCT<br>TCCTGTACTCCAAGCTGACTGTGGA<br>CAAGTCAAGATGGCAGCAGGGAAA<br>CGTGTTCTCCTGCTCCGTGATGCAC<br>GAAGCGCTGCACAACCATTACACCC<br>AGAAATCACTGTCACTTTCGCCGGG<br>AAAA |
| SEQ ID<br>2187 | QLQLQESGPGLVKPSQTLSLTCAISGDS<br>VSSNSAAWNWIRQSPSRGLEWLGRTY<br>YRSKWYNDYAVSVKSRITINPDTSKNQ<br>FSLQLNSVTPEDTAVYYCAEGNGPFDP<br>WGQGTLVTVSSASTKGPSVFPLAPSSK<br>STSGGTAALGCLVKDYFPEPVTVSWN<br>SGALTSGVHTFPAVLQSSGLYSLSSVV<br>TVPSSSLGTQTYICNVNHKPSNTKVDK<br>KVEPKSCDKTHTCPPCPAPELLGGPSV<br>FLFPPKPKDTLMISRTPEVTCVVVDVS<br>HEDPEVKFNWYVDGVEVHNAKTKPR<br>EEQYASTYRVVSVLTVLHQDWLNGKE<br>YKCKVSNKALPAPIEKTISKAKGQPRE<br>PQVYTLPPSREEMTKNQVSLTCLVKGF<br>YPSDIAVEWESNGQPENNYKTTPPVLD<br>SDGSFFLYSKLTVDKSRWQQGNVFSCS<br>VMHEALHNHYTQKSLSLSPGK | SEQ ID<br>2295 | CAGCTGCAGCTGCAGGAGTCGGGTC<br>CAGGACTGGTGAAGCCCTCGCAGAC<br>CCTCTCACTCACCTGTGCCATCTCCG<br>GGGACAGTGTCTCTAGCAACAGTGC<br>TGCTTGGAACTGGATCAGGCAGTCC<br>CCATCGAGAGGCCTTGAGTGGCTGG<br>GAAGGACATACTACAGGTCCAAGTG<br>GTATAATGATTATGCAGTATCTGTG<br>AAAAGTCGAATAACCATCAACCCAG<br>ACACATCCAAGAACCAGTTCTCCCT<br>GCAGCTGAACTCTGTGACTCCCGAG<br>GACACGGCTGTGTATTACTGTGCAG<br>AAGGCAATGGGCCGTTCGACCCCTG<br>GGGCCAGGGAACCCTGGTGACCGTC<br>TCCTCAGCATCCACCAAGGGGCCTT<br>CCGTGTTCCCCCTGGCCCCTTCATCC<br>AAGTCGACCTCTGGTGGAACCGCCG<br>CACTCGGTTGCCTGGTCAAAGACTA<br>CTTCCCCGAGCCCGTGACTGTCTCG<br>TGGAACTCGGGCGCCCTCACATCCG<br>GAGTGCATACCTTTCCCGCCGTGTT<br>GCAGTCCAGCGGCCTGTACAGCCTG<br>AGCTCCGTCGTGACAGTGCCGTCCT<br>CCTCCCTTGGAACCCAGACCTATAT<br>CTGCAACGTCAATCACAAGCCCTCC<br>AACACCAAAGTGGACAAGAAGGTC<br>GAACCCAAGTCCTGCGACAAGACTC<br>ACACCTGTCCGCCTTGTCCAGCCCC<br>TGAGCTGCTGGGTGGTCCGTCCGTG<br>TTCCTCTTCCCGCCCAAGCCGAAGG<br>ACACTCTGATGATTTCACGCACCCC<br>GGAAGTCACTTGCGTGGTCGTGGAC<br>GTGTCGCACGAAGATCCCGAAGTGA<br>AATTCAATTGGTACGTGGATGGGGT<br>CGAAGTGCACAACGCCAAGACCAA<br>GCCTAGGGAAGAACAGTACgccTCTA<br>CGTACCGGGTGGTGTCCGTGCTGAC<br>CGTGCTGCACCAGGACTGGCTGAAC<br>GGAAAGGAGTACAAGTGCAAAGTG<br>TCAAACAAGGCTCTCCCTGCCCCTA<br>TCGAAAAGACCATCAGCAAGGCCA<br>AGGGTCAACCTAGGGAGCCCCAGGT<br>CTACACTTTGCCGCCTAGCCGGGAA<br>GAAATGACTAAGAACCAAGTGTCCC<br>TGACTTGCCTTGTCAAGGGCTTTTAT<br>CCGTCCGACATCGCCGTGGAGTGGG<br>AGTCCAACGGACAACCGGAGAACA<br>ACTACAAGACCACCCCACCGGTGCT<br>CGATTCCGATGGCTCCTTCTTCCTGT<br>ACTCCAAGCTGACTGTGGACAAGTC<br>AAGATGGCAGCAGGGAAACGTGTT<br>CTCCTGCTCCGTGATGCACGAAGCG<br>CTGCACAACCATTACACCCAGAAAT<br>CACTGTCACTTTCGCCGGGAAAA |
| SEQ ID<br>2188 | QITLKESGGGVVQPGRSLRLSCVASGF<br>TFSTYPMHWVRQAPGKGLEWVAVISY<br>DGRNEYYADSVKGRFTISRDNSKNTL<br>YLQMNSLRAEDTAVYYCATRDTPLVG<br>VSIYWGQGTLVTVSSASTKGPSVFPLA | SEQ ID<br>2296 | CAGATCACCTTGAAGGAGTCTGGGG<br>GAGGCGTGGTCCAGCCTGGGAGGTC<br>CCTGAGACTCTCCTGTGTAGCCTCT<br>GGATTCACCTTCAGTACCTATCCCA<br>TGCACTGGGTCCGCCAGGCTCCAGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | | CAAGGGGCTGGAGTGGGTGGCAGTT ATATCATATGATGGACGTAATGAAT ACTACGCAGACTCCGTGAAGGGCCG ATTCACCATCTCCAGAGACAATTCC AAAAACACGCTGTATCTGCAAATGA ACAGTCTGCGAGCTGAAGACACGGC TGTCTATTATTGTGCGACTCGGGAT ACACCTTTGGTTGGGGTTTCGATAT ACTGGGGCCAGGGCACCCTGGTCAC CGTGTCCTCAGCATCCACCAAGGGG CCTTCCGTGTTCCCCCTGGCCCCTTC ATCCAAGTCGACCTCTGGTGGAACC GCCGCACTCGGTTGCCTGGTCAAAG ACTACTTCCCCGAGCCCGTGACTGT CTCGTGGAACTCGGGCGCCCTCACA TCCGGAGTGCATACCTTTCCGCCG TGTTGCAGTCCAGCGGCCTGTACAG CCTGAGCTCCGTCGTGACAGTGCCG TCCTCCTCCCTTGGAACCCAGACCT ATATCTGCAACGTCAATCACAAGCC CTCCAACACCAAAGTGGACAAGAA GGTCGAACCCAAGTCCTGCGACAAG ACTCACACCTGTCCGCCTTGTCCAG CCCCTGAGCTGCTGGGTGGTCCGTC CGTGTTCCTCTTCCCGCCCAAGCCG AAGGACACTCTGATGATTTCACGCA CCCCGGAAGTCACTTGCGTGGTCGT GGACGTGTCGCACGAAGATCCCGAA GTGAAATTCAATTGGTACGTGGATG GGGTCGAAGTGCACAACGCCAAGA CCAAGCCTAGGGAAGAACAGTACgc cTCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2189 | QMQLVQSGGGLVKAGGSLRLSCSASG FTFSSYAMHWVRQAPGKGLEYVSAISS NGGSTYYADSVKGRFTISRDNSKNTLY LQMSSLRAEDTAVYYCVNRAGYGDY RHFQHWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2297 | CAGATGCAGCTGGTGCAATCTGGGG GAGGCCTGGTCAAGGCTGGGGGGTC CCTGAGACTCTCCTGTTCAGCCTCTG GATTCACCTTCAGTAGCTATGCTAT GCACTGGGTCCGCCAGGCTCCAGGG AAGGGACTGGAATATGTTTCAGCTA TTAGTAGTAATGGGGGTAGCACATA CTACGCAGACTCAGTGAAGGGCCGA ATTCACCATCTCCAGAGACAATTCC AAGAACACGCTGTATCTTCAAATGA GCAGTCTGAGAGCTGAGGACACGG CTGTGTATTACTGTGTGAATCGGGC GGGTTACGGTGACTACAGACACTTC CAGCACTGGGGCCAGGGCACCCTGG TCACCGTCTCCTCAGCATCCACCAA GGGGCCTTCCGTGTTCCCCCTGGCC CCTTCATCCAAGTCGACCTCTGGTG GAACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AAGCCCTCCAACACCAAAGTGGACA
AGAAGGTCGAACCCAAGTCCTGCGA
CAAGACTCACACCTGTCCGCCTTGT
CCAGCCCCTGAGCTGCTGGGTGGTC
CGTCCGTGTTCCTCTTCCCGCCCAAG
CCGAAGGACACTCTGATGATTTCAC
GCACCCCGGAAGTCACTTGCGTGGT
CGTGGACGTGTCGCACGAAGATCCC
GAAGTGAAATTCAATTGGTACGTGG
ATGGGGTCGAAGTGCACAACGCCA
AGACCAAGCCTAGGGAAGAACAGT
ACgccTCTACGTACCGGGTGGTGTCC
GTGCTGACCGTGCTGCACCAGGACT
GGCTGAACGGAAAGGAGTACAAGT
GCAAAGTGTCAAACAAGGCTCTCCC
TGCCCCTATCGAAAAGACCATCAGC
AAGGCCAAGGGTCAACCTAGGGAG
CCCCAGGTCTACACTTTGCCGCCTA
GCCGGGAAGAAATGACTAAGAACC
AAGTGTCCCTGACTTGCCTTGTCAA
GGGCTTTTATCCGTCCGACATCGCC
GTGGAGTGGGAGTCCAACGGACAA
CCGGAGAACAACTACAAGACCACC
CCACCGGTGCTCGATTCCGATGGCT
CCTTCTTCCTGTACTCCAAGCTGACT
GTGGACAAGTCAAGATGGCAGCAG
GGAAACGTGTTCTCCTGCTCCGTGA
TGCACGAAGCGCTGCACAACCATTA
CACCCAGAAATCACTGTCACTTTCG
CCGGGAAAA |
| SEQ ID 2190 | EVQLVQSGGGVVQPGGSLRLSCAASG
FTFSSYGMHWVRQAPGKGLEWVAFIS
YDGSNKYYADSVKGRFTISRDNSKNT
LYLQMNSLRAEDTAVYYCATTGDRFQ
EFDYWGQGTLVTVSSASTKGPSVFPLA
PSSKSTSGGTAALGCLVKDYFPEPVTV
SWNSGALTSGVHTFPAVLQSSGLYSLS
SVVTVPSSSLGTQTYICNVNHKPSNTK
VDKKVEPKSCDKTHTCPPCPAPELLGG
PSVFLFPPKPKDTLMISRTPEVTCVVVD
VSHEDPEVKFNWYVDGVEVHNAKTK
PREEQYASTYRVVSVLTVLHQDWLNG
KEYKCKVSNKALPAPIEKTISKAKGQP
REPQVYTLPPSREEMTKNQVSLTCLVK
GFYPSDIAVEWESNGQPENNYKTTPPV
LDSDGSFFLYSKLTVDKSRWQQGNVF
SCSVMHEALHNHYTQKSLSLSPGK | SEQ ID 2298 | GAGGTGCAGCTGGTGCAGTCTGGGG
GAGGCGTGGTCCAGCCTGGGGGGTC
CCTGAGACTCTCCTGTGCAGCGTCT
GGATTCACCTTCAGTAGCTATGGCA
TGCACTGGGTCCGCCAGGCTCCAGG
CAAGGGGCTGGAGTGGGTGGCATTT
ATATCATATGATGGAAGTAATAAAT
ACTACGCAGACTCCGTGAAGGGCCG
ATTCACCATCTCCAGAGACAATTCC
AAGAACACGCTGTATCTGCAAATGA
ACAGCCTGAGAGCCGAGGACACGG
CCGTATATTACTGTGCGACAACAGG
GGACCGCTTCCAAGAGTTTGACTAC
TGGGGCCAGGGAACCCTGGTCACCG
TCTCCTCAGCATCCACCAAGGGCCC
TTCCGTGTTCCCCCTGGCCCCTTCAT
CCAAGTCGACCTCTGGTGGAACCGC
CGCACTCGGTTGCCTGGTCAAAGAC
TACTTCCCCGAGCCCGTGACTGTCT
CGTGGAACTCGGGCGCCCTCACATC
CGGAGTGCATACCTTTCCCGCCGTG
TTGCAGTCCAGCGGCCTGTACAGCC
TGAGCTCCGTCGTGACAGTGCCGTC
CTCCTCCCTTGGAACCCAGACCTAT
ATCTGCAACGTCAATCACAAGCCCT
CCAACACCAAAGTGGACAAGAAGG
TCGAACCCAAGTCCTGCGACAAGAC
TCACACCTGTCCGCCTTGTCCAGCC
CCTGAGCTGCTGGGTGGTCCGTCCG
TGTTCCTCTTCCCGCCCAAGCCGAA
GGACACTCTGATGATTTCACGCACC
CCGGAAGTCACTTGCGTGGTCGTGG
ACGTGTCGCACGAAGATCCCGAAGT
GAAATTCAATTGGTACGTGGATGGG
GTCGAAGTGCACAACGCCAAGACC
AAGCCTAGGGAAGAACAGTACgccT
CTACGTACCGGGTGGTGTCCGTGCT
GACCGTGCTGCACCAGGACTGGCTG
AACGGAAAGGAGTACAAGTGCAAA
GTGTCAAACAAGGCTCTCCCTGCCC
CTATCGAAAAGACCATCAGCAAGGC
CAAGGGTCAACCTAGGGAGCCCCA
GGTCTACACTTTGCCGCCTAGCCGG
GAAGAAATGACTAAGAACCAAGTG
TCCCTGACTTGCCTTGTCAAGGGCTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TTATCCGTCCGACATCGCCGTGGAG<br>TGGGAGTCCAACGGACAACCGGAG<br>AACAACTACAAGACCACCCCACCGG<br>TGCTCGATTCCGATGGCTCCTTCTTC<br>CTGTACTCCAAGCTGACTGTGGACA<br>AGTCAAGATGGCAGCAGGGAAACG<br>TGTTCTCCTGCTCCGTGATGCACGA<br>AGCGCTGCACAACCATTACACCCAG<br>AAATCACTGTCACTTTCGCCGGGAA<br>AA |
| SEQ ID 2191 | QMQLVQSGGVLLQPGRSLRLSCTASG<br>FTFAAYNINWFRQGPGGGLEWVGFIR<br>ANADSGTTEYAASVKGRFFISRDDSRS<br>TAYLQMTSLKTEDTAVYYCARDDRGR<br>GDDFDYWGQGTLVTVSSASTKGPSVF<br>PLAPSSKSTSGGTAALGCLVKDYFPEP<br>VTVSWNSGALTSGVHTFPAVLQSSGL<br>YSLSSVVTVPSSSLGTQTYICNVNHKPS<br>NTKVDKKVEPKSCDKTHTCPPCPAPEL<br>LGGPSVFLFPPKPKDTLMISRTPEVTCV<br>VVDVSHEDPEVKFNWYVDGVEVHNA<br>KTKPREEQYASTYRVVSVLTVLHQDW<br>LNGKEYKCKVSNKALPAPIEKTISKAK<br>GQPREPQVYTLPPSREEMTKNQVSLTC<br>LVKGFYPSDIAVEWESNGQPENNYKT<br>TPPVLDSDGSFFLYSKLTVDKSRWQQG<br>NVFSCSVMHEALHNHYTQKSLSLSPG<br>K | SEQ ID 2299 | CAGATGCAGCTGGTGCAGTCTGGGG<br>GAGTCCTTGCTTCAGCCAGGGCGTC<br>CCTGAGACTCTCCTGTACAGCTTCT<br>GGATTCACCTTTGCTGCTTATAATAT<br>CAACTGGTTCCGCCAGGGTCCTGGG<br>GGGGGGCTGGAGTGGGTAGGTTTCA<br>TTAGAGCCAACGCTGATAGTGGGAC<br>AACAGAGTACGCCGCGTCTGTGAAA<br>GGCAGATTCTTCATCTCAAGAGATG<br>ATTCCAGAAGCACCGCCTACCTGCA<br>AATGACTAGCCTTAAAACCGAGGAC<br>ACAGCCGTTTATTACTGTGCCAGAG<br>ATGATCGGGGTCGGGGAGATGACTT<br>TGACTACTGGGGCCAGGGCACCCTG<br>GTCACCGTCTCCTCAGCATCCACCA<br>AGGGGCCTTCCGTGTTCCCCCTGGC<br>CCCTTCATCCAAGTCGACCTCTGGT<br>GGAACCGCCGCACTCGGTTGCCTGG<br>TCAAAGACTACTTCCCCGAGCCCGT<br>GACTGTCTCGTGGAACTCGGGCGCC<br>CTCACATCCGGAGTGCATACCTTTC<br>CCGCCGTGTTGCAGTCCAGCGGCCT<br>GTACAGCCTGAGCTCCGTCGTGACA<br>GTGCCGTCCTCCTCCCTTGGAACCC<br>AGACCTATATCTGCAACGTCAATCA<br>CAAGCCCTCCAACACCAAAGTGGAC<br>AAGAAGGTCGAACCCAAGTCCTGCG<br>ACAAGACTCACACCTGTCCGCCTTG<br>TCCAGCCCCTGAGCTGCTGGGTGGT<br>CCGTCCGTGTTCCTCTTCCCGCCCAA<br>GCCGAAGGACACTCTGATGATTTCA<br>CGCACCCCGGAAGTCACTTGCGTGG<br>TCGTGGACGTGTCGCACGAAGATCC<br>CGAAGTGAAATTCAATTGGTACGTG<br>GATGGGGTCGAAGTGCACAACGCC<br>AAGACCAAGCCTAGGGAAGAACAG<br>TACgccTCTACGTACCGGGTGGTGTC<br>CGTGCTGACCGTGCTGCACCAGGAC<br>TGGCTGAACGGAAAGGAGTACAAG<br>TGCAAAGTGTCAAACAAGGCTCTCC<br>CTGCCCCTATCGAAAAGACCATCAG<br>CAAGGCCAAGGGTCAACCTAGGGA<br>GCCCCAGGTCTACACTTTGCCGCCT<br>AGCCGGGAAGAAATGACTAAGAAC<br>CAAGTGTCCCTGACTTGCCTTGTCA<br>AGGGCTTTTATCCGTCCGACATCGC<br>CGTGGAGTGGGAGTCCAACGGACA<br>ACCGGAGAACAACTACAAGACCAC<br>CCCACCGGTGCTCGATTCCGATGGC<br>TCCTTCTTCCTGTACTCCAAGCTGAC<br>TGTGGACAAGTCAAGATGGCAGCA<br>GGGAAACGTGTTCTCCTGCTCCGTG<br>ATGCACGAAGCGCTGCACAACCATT<br>ACACCCAGAAATCACTGTCACTTTC<br>GCCGGGAAAA |
| SEQ ID 2192 | QVQLVQSGGGLVQPGGSLRLSCAASG<br>FTFSSYGMTWVRQAPGKGLEWVSTIS<br>GNGVGTYYPDSVKDRFTISRDSSKNTV<br>YLQMNSLRAEDTAVYYCVKHGRAGIN<br>WYFDLWGRGTLVTVSSASTKGPSVFP<br>LAPSSKSTSGGTAALGCLVKDYFPEPV<br>TVSWNSGALTSGVHTFPAVLQSSGLYS<br>LSSVVTVPSSSLGTQTYICNVNHKPSNT<br>KVDKKVEPKSCDKTHTCPPCPAPELLG | SEQ ID 2300 | CAGGTGCAGCTGGTGCAATCTGGGG<br>GAGGCTTGGTACAGCCTGGGGGGTC<br>CCTGAGACTCTCCTGTGCAGCCTCT<br>GGATTCACCTTTAGCAGCTATGGCA<br>TGACTTGGGTCCGCCAGGCTCCAGG<br>GAAGGGGCTGGAGTGGGTCTCAACT<br>ATTAGTGGTAATGGTGTTGGCACAT<br>ACTACCCAGACTCCGTGAAGGACCG<br>GTTCACCATCTCCAGAGACAGTTCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | | AAGAACACGGTGTATCTGCAAATGA ACAGCCTGAGAGCCGAGGACACGG CCGTATATTACTGTGTGAAACATGG TAGGGCCGGAATAAACTGGTACTTC GATCTCTGGGGCCGTGGCACCCTGG TGACCGTCTCCTCAGCATCCACCAA GGGGCCTTCCGTGTTCCCCCTGGCC CCTTCATCCAAGTCGACCTCTGGTG GAACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC AAGCCCTCCAACACCAAAGTGGACA AGAAGGTCGAACCCAAGTCCTGCGA CAAGACTCACACCTGTCCGCCTTGT CCAGCCCCTGAGCTGCTGGGTGGTC CGTCCGTGTTCCTCTTCCCGCCCAAG CCGAAGGACACTCTGATGATTTCAC GCACCCCGGAAGTCACTTGCGTGGT CGTGGACGTGTCGCACGAAGATCCC GAAGTGAAATTCAATTGGTACGTGG ATGGGGTCGAAGTGCACAACGCCA AGACCAAGCCTAGGGAAGAACAGT ACgccTCTACGTACCGGGTGGTGTCC GTGCTGACCGTGCTGCACCAGGACT GGCTGAACGGAAAGGAGTACAAGT GCAAAGTGTCAAACAAGGCTCTCCC TGCCCCTATCGAAAAGACCATCAGC AAGGCCAAGGGTCAACCTAGGGAG CCCCAGGTCTACACTTTGCCGCCTA GCCGGGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCAAGCTGACT GTGGACAAGTCAAGATGGCAGCAG GGAAACGTGTTCTCCTGCTCCGTGA TGCACGAAGCGCTGCACAACCATTA CACCCAGAAATCACTGTCACTTTCG CCGGGAAAA |
| SEQ ID 2193 | QVQLQQSGPGLVKPSQTLSLTCAISGD SVSSNSAAWNWIRQSPSRGLEWLGRT YYRSKWYNDYAVSVKSRITINPDTSKN QFSLQLNSVTPEDTAVYYCARGGGLW AFDIWGQGTTVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2301 | CAGGTACAGCTGCAGCAGTCAGGTC CAGGACTGGTGAAGCCCTCGCAGAC CCTTCTCACTCACCTGTGCCATCTCCG GGGACAGTGTCTCTAGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGCTGTGTATTACTGTGCAA GAGGGGGAGGGCTTTGGGCTTTTGA TATCTGGGGCCAAGGGACCACGGTC ACCGTCTCCTCAGCATCCACCAAGG GGCCTTCCGTGTTCCCCCTGGCCCCT TCATCCAAGTCGACCTCTGGTGGAA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCCAGAC CTATATCTGCAACGTCAATCACAAG CCCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC CCCTATCGAAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA CGTGTTCTCCTGCTCCGTGATGCAC GAAGCGCTGCACAACCATTACACCC AGAAATCACTGTCACTTTCGCCGGG AAAA |
| SEQ ID 2194 | EVQLVQSGAEVKKPGASVKVSCKASG YTFTGYYMHWVRQAPGQGLEWMGW INPNSGGTNYAQKFQGRVTMTRDTSIS TAYMELSRLRSDDTAVYYCARDKIGS CPYWGQGTLVTVSSASTKGPSVFPLAP SSKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2302 | GAGGTCCAGCTGGTGCAGTCTGGGG CTGAGGTGAAGAAGCCTGGGGCCTC AGTGAAGGTCTCCTGCAAGGCTTCT GGATACACCTTCACCGGCTACTATA TGCACTGGGTGCGACAGGCCCCTGG ACAAGGGCTTGAGTGGATGGGATG GATCAACCCTAACAGTGGTGGCACA AACTATGCACAGAAGTTTCAGGGCA GGGTCACCATGACCAGGGACACGTC CATCAGCACAGCCTACATGGAGCTG AGCAGGCTGAGATCTGACGACACG GCCGTGTATTACTGTGCGAGAGACA AGATCGGCAGCTGTCCTTACTGGGG CCAGGGAACCCTGGTCACCGTCTCC TCAGCATCCACCAAGGGGCCTTCCG TGTTCCCCCTGGCCCCTTCATCCAAG TCGACCTCTGGTGGAACCGCCGCAC TCGGTTGCCTGGTCAAAGACTACTT CCCCGAGCCCGTGACTGTCTCGTGG AACTCGGGCGCCCTCACATCCGGAG TGCATACCTTTCCCGCCGTGTTGCA GTCCAGCGGCCTGTACAGCCTGAGC TCCGTCGTGACAGTGCCGTCCTCCT CCCTTGGAACCCAGACCTATATCTG CAACGTCAATCACAAGCCCTCCAAC ACCAAAGTGGACAAGAAGGTCGAA CCCAAGTCCTGCGACAAGACTCACA CCTGTCCGCCTTGTCCAGCCCCTGA GCTGCTGGGTGGTCCGTCCGTGTTC CTCTTCCCGCCCAAGCCGAAGGACA CTCTGATGATTTCACGCACCCCGGA AGTCACTTGCGTGGTCGTGGACGTG TCGCACGAAGATCCCGAAGTGAAAT TCAATTGGTACGTGGATGGGGTCGA AGTGCACAACGCCAAGACCAAGCCT AGGGAAGAACAGTACgccTCTACGTA CCGGGTGGTGTCCGTGCTGACCGTG CTGCACCAGGACTGGCTGAACGGAA AGGAGTACAAGTGCAAAGTGTCAA ACAAGGCTCTCCCTGCCCCTATCGA AAAGACCATCAGCAAGGCCAAGGG TCAACCTAGGGAGCCCCAGGTCTAC ACTTTGCCGCCTAGCCGGGAAGAAA TGACTAAGAACCAAGTGTCCCTGAC TTGCCTTGTCAAGGGCTTTTATCCGT CCGACATCGCCGTGGAGTGGGAGTC CAACGGACAACCGGAGAACAACTA CAAGACCACCCCACCGGTGCTCGAT TCCGATGGCTCCTTCTTCCTGTACTC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CAAGCTGACTGTGGACAAGTCAAGA<br>TGGCAGCAGGGAAACGTGTTCTCCT<br>GCTCCGTGATGCACGAAGCGCTGCA<br>CAACCATTACACCCAGAAATCACTG<br>TCACTTTCGCCGGGAAAA |
| SEQ ID 2195 | QVTLKESGPTLVKPTQTLTLTCTFSGFS<br>LSTSGVGVGWIRQPPGKALEWLALIY<br>WDDDKRYSPSLKSRLTITKDTSKNQV<br>VLTMTNMDPVDTATYYCAHRPDSSSQ<br>CFDYWGQGTLVTVSSASTKGPSVFPLA<br>PSSKSTSGGTAALGCLVKDYFPEPVTV<br>SWNSGALTSGVHTFPAVLQSSGLYSLS<br>SVVTVPSSSLGTQTYICNVNHKPSNTK<br>VDKKVEPKSCDKTHTCPPCPAPELLGG<br>PSVFLFPPKPKDTLMISRTPEVTCVVVD<br>VSHEDPEVKFNWYVDGVEVHNAKTK<br>PREEQYASTYRVVSVLTVLHQDWLNG<br>KEYKCKVSNKALPAPIEKTISKAKGQP<br>REPQVYTLPPSREEMTKNQVSLTCLVK<br>GFYPSDIAVEWESNGQPENNYKTTPPV<br>LDSDGSFFLYSKLTVDKSRWQQGNVF<br>SCSVMHEALHNHYTQKSLSLSPGK | SEQ ID 2303 | CAGGTCACCTTGAAGGAGTCTGGTC<br>CTACGCTGGTGAAACCCACACAGAC<br>CCTCACGCTGACCTGCACCTTCTCTG<br>GGTTCTCACTCAGCACTAGTGGAGT<br>GGGTGTGGGCTGGATCCGTCAGCCC<br>CCAGGAAAGGCCCTGGAGTGGCTTG<br>CACTCATTTATTGGGATGATGATAA<br>GCGCTACAGCCCATCTCTGAAGAGC<br>AGGCTCACCATCACCAAGGACACCT<br>CCAAAAACCAGGTGGTCCTTACAAT<br>GACCAACATGGACCCTGTGGACACA<br>GCCACATATTACTGTGCACACAGAC<br>CGGATAGCAGCAGTCAATGTTTTGA<br>CTACTGGGGCCAGGGAACCCTGGTC<br>ACCGTCTCCTCAGCATCCACCAAGG<br>GCCTTCCGTGTTCCCCCTGGCCCCT<br>TCATCCAAGTCGACCTCTGGTGGAA<br>CCGCCGCACTCGGTTGCCTGGTCAA<br>AGACTACTTCCCCGAGCCCGTGACT<br>GTCTCGTGGAACTCGGGCGCCCTCA<br>CATCCGGAGTGCATACCTTTCCCGC<br>CGTGTTGCAGTCCAGCGGCCTGTAC<br>AGCCTGAGCTCCGTCGTGACAGTGC<br>CGTCCTCCTCCCTTGGAACCCAGAC<br>CTATATCTGCAACGTCAATCACAAG<br>CCCTCCAACACCAAAGTGGACAAGA<br>AGGTCGAACCCAAGTCCTGCGACAA<br>GACTCACACCTGTCCGCCTTGTCCA<br>GCCCCTGAGCTGCTGGGTGGTCCGT<br>CCGTGTTCCTCTTCCCGCCCAAGCC<br>GAAGGACACTCTGATGATTTCACGC<br>ACCCCGGAAGTCACTTGCGTGGTCG<br>TGGACGTGTCGCACGAAGATCCCGA<br>AGTGAAATTCAATTGGTACGTGGAT<br>GGGGTCGAAGTGCACAACGCCAAG<br>ACCAAGCCTAGGGAAGAACAGTACg<br>ccTCTACGTACCGGGTGGTGTCCGTG<br>CTGACCGTGCTGCACCAGGACTGGC<br>TGAACGGAAAGGAGTACAAGTGCA<br>AAGTGTCAAACAAGGCTCTCCCTGC<br>CCCTATCGAAAAGACCATCAGCAAG<br>GCCAAGGGTCAACCTAGGGAGCCCC<br>AGGTCTACACTTTGCCGCCTAGCCG<br>GGAAGAAATGACTAAGAACCAAGT<br>GTCCCTGACTTGCCTTGTCAAGGGC<br>TTTTATCCGTCCGACATCGCCGTGG<br>AGTGGGAGTCCAACGGACAACCGG<br>AGAACAACTACAAGACCACCCCACC<br>GGTGCTCGATTCCGATGGCTCCTTCT<br>TCCTGTACTCCAAGCTGACTGTGGA<br>CAAGTCAAGATGGCAGCAGGGAAA<br>CGTGTTCTCCTGCTCCGTGATGCAC<br>GAAGCGCTGCACAACCATTACACCC<br>AGAAATCACTGTCACTTTCGCCGGG<br>AAAA |
| SEQ ID 2196 | QVTLKESGGGVVQPGRSLRLSCAASGF<br>TFSSYAMHWVRQAPGKGLEWVAVISY<br>DGSNKYYADSVKGRFTISRDNSKNTL<br>YLQMNSLRAEDTAVYYCARSSGWSLP<br>EDYWGQGTLVTVSSASTKGPSVFPLAP<br>SSKSTSGGTAALGCLVKDYFPEPVTVS<br>WNSGALTSGVHTFPAVLQSSGLYSLSS<br>VVTVPSSSLGTQTYICNVNHKPSNTKV<br>DKKVEPKSCDKTHTCPPCPAPELLGGP<br>SVFLFPPKPKDTLMISRTPEVTCVVVD<br>VSHEDPEVKFNWYVDGVEVHNAKTK<br>PREEQYASTYRVVSVLTVLHQDWLNG<br>KEYKCKVSNKALPAPIEKTISKAKGQP<br>REPQVYTLPPSREEMTKNQVSLTCLVK | SEQ ID 2304 | CAGGTCACCTTGAAGGAGTCTGGGG<br>GAGGCGTGGTCCAGCCTGGGAGGTC<br>CCTGAGACTCTCCTGTGCAGCCTCT<br>GGATTCACCTTCAGTAGCTATGCTA<br>TGCACTGGTCCGCCAGGCTCCAGG<br>CAAGGGGCTGGAGTGGGTGGCAGTT<br>ATATCATATGATGGAAGTAATAAAT<br>ACTACGCAGACTCCGTGAAGGGCCG<br>ATTCACCATCTCCAGAGACAATTCC<br>AAGAACACGCTGTATCTGCAAATGA<br>ACAGCCTGAGAGCTGAGGACACGG<br>CTGTGTATTACTGTGCGAGAAGCAG<br>TGGCTGGTCACTGCCTGAAGACTAC<br>TGGGGCCAGGGAACCCTGGTCACCG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | GFYPSDIAVEWESNGQPENNYKTTPPV LDSDGSFFLYSKLTVDKSRWQQGNVF SCSVMHEALHNHYTQKSLSLSPGK | | TCTCCTCAGCATCCACCAAGGGGCC TTCCGTGTTCCCCCTGGCCCCTTCAT CCAAGTCGACCTCTGGTGGAACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCCAGACCTAT ATCTGCAACGTCAATCACAAGCCCT CCAACACCAAAGTGGACAAGAAGG TCGAACCCAAGTCCTGCGACAAGAC TCACACCTGTCCGCCTTGTCCAGCC CCTGAGCTGCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCACGAAGATCCCGAAGT GAAATTCAATTGGTACGTGGATGGG GTCGAAGTGCACAACGCCAAGACC AAGCCTAGGGAAGAACAGTACgccT CTACGTACCGGGTGGTGTCCGTGCT GACCGTGCTGCACCAGGACTGGCTG AACGGAAAGGAGTACAAGTGCAAA GTGTCAAACAAGGCTCTCCCTGCCC CTATCGAAAAGACCATCAGCAAGGC CAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2197 | QVQLVQSGAEVKKPGASVKVSCKVSG YTLTELSMHWVRQAPGKGLEWMGGF DPEDGETIYAQKFQGRVTMTEDTSTDT AYMELSSLRSEDTAVYYCATDVNPEL LGAGFDYWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2305 | CAGGTCCAGCTGGTACAGTCTGGGG CTGAGGTGAAGAAGCCTGGGGCCTC AGTGAAGGTCTCCTGCAAGGTTTCC GGATACACCCTCACTGAATTATCCA TGCACTGGGTGCGACAGGCTCCTGG AAAAGGGCTTGAGTGGATGGGAGG TTTTGATCCTGAAGATGGTGAAACA ATCTACGCACAGAAGTTCCAGGGCA GAGTCACCATGACCGAGGACACATC TACAGACACAGCCTACATGGAGCTG AGCAGCCTGAGATCTGAGGACACG GCCGTGTATTACTGTGCAACGGATG TGAACCCGGAGCTACTGGGGGCGG GATTTGACTACTGGGGCCAGGGCAC CCTGGTCACCGTCTCCTCAGCATCC ACCAAGGGGCCTTCCGTGTTCCCCC TGGCCCCTTCATCCAAGTCGACCTC TGGTGGAACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCCAGACCTATATCTGCAACGTCA ATCACAAGCCCTCCAACACCAAAGT GGACAAGAAGGTCGAACCCAAGTC CTGCGACAAGACTCACACCTGTCCG CCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCACGAA GATCCCGAAGTGAAATTCAATTGGT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | ACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2198 | QVTLKESGGGLVQPGGSLRLSCAASGF TFSDQYMDWVRQAPGKGLEWVGRVR NKANSYTTEYAASVKGRFTISRDDSKN SLYLQMNSLNTEDTAMYFCASSLNSG GYRCFHHWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2306 | CAGGTCACCTTGAAGGAGTCTGGGG GAGGCTTGGTCCAGCCTGGAGGGTC CCTGAGACTCTCCTGTGCAGCCTCT GGATTCACCTTCAGTGACCAGTACA TGGACTGGGTCCGCCAGGCTCCAGG GAAGGGGCTGGAGTGGGTTGGCCGT GTTAGAAACAAAGCTAACAGTTACA CCACAGAATACGCCGCGTCTGTGAA AGGCAGATTCACCATCTCAAGAGAT GATTCAAAGAACTCACTGTATCTGC AAATGAATAGTCTGAACACCGAGG ACACGGCCATGTATTTCTGTGCTAG TAGTCTCAATAGTGGGGGCTACCGA TGCTTCCATCACTGGGGCCAGGGCA CCCTGGTGACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GTGATGCACGAAGCGCTGCACAACC ATTACACCCAGAAATCACTGTCACT TTCGCCGGGAAAA |
| SEQ ID 2199 | QVQLVQSGGGLVQPGGSLRLSCSASGF TFSSYAMHWVRQAPGKGLEYVSAISS NGGSTYYADSVKGRFTISRDNSKNTLY LQMSSLRAEDTAVYYCVKAPRGVVPA AMRGGYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2307 | CAGGTCCAGCTGGTGCAGTCTGGGG GAGGCTTGGTCCAGCCTGGGGGGTC CCTGAGACTCTCCTGTTCAGCCTCTG GATTCACCTTCAGTAGCTATGCTAT GCACTGGGTCCGCCAGGCTCCAGGG AAGGGACTGGAATATGTTTCAGCTA TTAGTAGTAATGGGGGTAGCACATA CTACGCAGACTCAGTGAAGGGCAG ATTCACCATCTCCAGAGACAATTCC AAGAACACGCTGTATCTTCAAATGA GCAGTCTGAGAGCTGAGGACACGG CTGTGTATTACTGTGTGAAAGCGCC GAGGGGTGTAGTACCAGCTGCTATG CGGGGGGGCTACTGGGGCCAGGGA ACCCTGGTCACCGTCTCCTCAGCAT CCACCAAGGGGCCTTCCGTGTTCCC CCTGGCCCCTTCATCCAAGTCGACC TCTGGTGGAACCGCCGCACTCGGTT GCCTGGTCAAAGACTACTTCCCCGA GCCCGTGACTGTCTCGTGGAACTCG GGCGCCCTCACATCCGGAGTGCATA CCTTTCCCGCCGTGTTGCAGTCCAG CGGCCTGTACAGCCTGAGCTCCGTC GTGACAGTGCCGTCCTCCTCCCTTG GAACCCAGACCTATATCTGCAACGT CAATCACAAGCCCTCCAACACCAAA GTGGACAAGAAGGTCGAACCCAAG TCCTGCGACAAGACTCACACCTGTC CGCCTTGTCCAGCCCCTGAGCTGCT GGGTGGTCCGTCCGTGTTCCTCTTCC CGCCCAAGCCGAAGGACACTCTGAT GATTTCACGCACCCCGGAAGTCACT TGCGTGGTCGTGGACGTGTCGCACG AAGATCCCGAAGTGAAATTCAATTG GTACGTGGATGGGGTCGAAGTGCAC AACGCCAAGACCAAGCCTAGGGAA GAACAGTACgccTCTACGTACCGGGT GGTGTCCGTGCTGACCGTGCTGCAC CAGGACTGGCTGAACGGAAAGGAG TACAAGTGCAAAGTGTCAAACAAG GCTCTCCCTGCCCCTATCGAAAAGA CCATCAGCAAGGCCAAGGGTCAACC TAGGGAGCCCCAGGTCTACACTTTG CCGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2200 | QVQLQESGGGLVQPGRSLRLSCTASGF TFGDYAMSWFRQAPGKGLEWVGFIRS KAYGGTTEYAASVKGRFTISRDDSKSI AYLQMNSLKTEDTAVYYCTRLVGNSG SYYPFGYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC | SEQ ID 2308 | CAGGTGCAGCTGCAGGAGTCGGGG GGAGGCTTGGTACAGCCAGGGCGGT CCCTGAGACTCTCCTGTACAGCTTCT GGATTCACCTTTGGTGATTATGCTAT GAGCTGGTTCCGCCAGGCTCCAGGG AAGGGGCTGGAGTGGGTAGGTTTCA TTAGAAGCAAAGCTTATGGTGGGAC AACAGAATACGCCGCGTCTGTGAAA GGCAGATTCACCATCTCAAGAGATG ATTCCAAAAGCATCGCCTATCTGCAA ATGAACAGCCTGAAAACCGAGGA CACAGCCGTGTATTACTGTACTAGA TTGGTGGGCAATAGTGGGAGCTACT ATCCGTTTGGGTACTGGGGCCAGGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | LVKGFYPSDIAVEWESNGQPENNYKT TPPVLDSDGSFFLYSKLTVDKSRWQQG NVFSCSVMHEALHNHYTQKSLSLSPG K | | AACCCTGGTGACCGTCTCCTCAGCA TCCACCAAGGGGCCTTCCGTGTTCC CCCTGGCCCCTTCATCCAAGTCGAC CTCTGGTGGAACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACGccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2201 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARGRSLPYRGLA PRSFGGYYFDYWGQGTLVTVSSASTK GPSVFPLAPSSKSTSGGTAALGCLVKD YFPEPVTVSWNSGALTSGVHTFPAVLQ SSGLYSLSSVVTVPSSSLGTQTYICNVN HKPSNTKVDKKVEPKSCDKTHTCPPCP APELLGGPSVFLFPPKPKDTLMISRTPE VTCVVVDVSHEDPEVKFNWYVDGVE VHNAKTKPREEQYASTYRVVSVLTVL HQDWLNGKEYKCKVSNKALPAPIEKT ISKAKGQPREPQVYTLPPSREEMTKNQ VSLTCLVKGFYPSDIAVEWESNGQPEN NYKTTPPVLDSDGSFFLYSKLTVDKSR WQQGNVFSCSVMHEALHNHYTQKSL SLSPGK | SEQ ID 2309 | CAGGTGCAGCTACAGCAGTGGGGC GCAGGACTGTTGAAGCCTTCGGAGA CCCTGTCCCTCACCTGCGCTGTCTAT GGTGGCTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCGGTGACCGCCGCGGACACGGCTG TGTATTACTGTGCGAGAGGCCGGTC CCTTCCCTACCGGGGGTTGGCTCCT AGATCTTTCGGAGGATACTACTTTG ACTACTGGGGCCAGGGAACCCTGGT CACCGTCTCCTCAGCATCCACCAAG GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCCGGTGCTCGATTCCGATGGCTC CTTCTTCCTGTACTCCAAGCTGACTG TGGACAAGTCAAGATGGCAGCAGG GAAACGTGTTCTCCTGCTCCGTGAT GCACGAAGCGCTGCACAACCATTAC ACCCAGAAATCACTGTCACTTTCGC CGGGAAAA |
| SEQ ID 2202 | QVQLQESGGGLVRPGGSLRLSCGDSGF NFSGYEMNWVRQAPGKGLEWVSYVS TSGSTRYYADSVKGRFTISRDNAKNTL YLQMNSLRVEDTAVYYCARGRTHWG PQDFDYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2310 | CAGGTGCAGCTGCAGGAGTCGGGG GGAGGCTTGGTACGGCCTGGAGGGT CCCTGAGACTCTCCTGTGGAGACTC TGGATTCAACTTCAGTGGATATGAA ATGAACTGGGTCCGCCAGGCTCCAG GGAAGGGGCTGGAGTGGGTTTCATA CGTCAGTACTAGTGGTAGTACCAGA TACTACGCAGACTCTGTGAAGGGCC GATTTACCATCTCCAGAGACAACGC CAAGAACACCCTGTATTTGCAAATG AACAGTCTGAGAGTCGAGGACACG GCTGTGTATTACTGTGCAAGAGGAC GGACTCACTGGGGCCCCCAGGACTT TGACTACTGGGGCCAGGGAACCCTG GTCACCGTCTCCTCAGCATCCACCA AGGGGCCTTCCGTGTTCCCCCTGGC CCCTTCATCCAAGTCGACCTCTGGT GGAACCGCCGCACTCGGTTGCCTGG TCAAAGACTACTTCCCCGAGCCCGT GACTGTCTCGTGGAACTCGGGCGCC CTCACATCCGGAGTGCATACCTTTC CCGCCGTGTTGCAGTCCAGCGGCCT GTACAGCCTGAGCTCCGTCGTGACA GTGCCGTCCTCCTCCCTTGGAACCC AGACCTATATCTGCAACGTCAATCA CAAGCCCTCCAACACCAAAGTGGAC AAGAAGGTCGAACCCAAGTCCTGCG ACAAGACTCACACCTGTCCGCCTTG TCCAGCCCCTGAGCTGCTGGGTGGT CCGTCCGTGTTCCTCTTCCCGCCCAA GCCGAAGGACACTCTGATGATTTCA CGCACCCCGGAAGTCACTTGCGTGG TCGTGGACGTGTCGCACGAAGATCC CGAAGTGAAATTCAATTGGTACGTG GATGGGGTCGAAGTGCACAACGCC AAGACCAAGCCTAGGGAAGAACAG TACgccTCTACGTACCGGGTGGTGTC CGTGCTGACCGTGCTGCACCAGGAC TGGCTGAACGGAAAGGAGTACAAG TGCAAAGTGTCAAACAAGGCTCTCC CTGCCCCTATCGAAAAGACCATCAG CAAGGCCAAGGGTCAACCTAGGGA GCCCCAGGTCTACACTTTGCCGCCT AGCCGGGAAGAAATGACTAAGAAC CAAGTGTCCCTGACTTGCCTTGTCA AGGGCTTTTATCCGTCCGACATCGC CGTGGAGTGGGAGTCCAACGGACA ACCGGAGAACAACTACAAGACCAC CCCACCCGGTGCTCGATTCCGATGGC TCCTTCTTCCTGTACTCCAAGCTGAC TGTGGACAAGTCAAGATGGCAGCA GGGAAACGTGTTCTCCTGCTCCGTG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | ATGCACGAAGCGCTGCACAACCATT ACACCCAGAAATCACTGTCACTTTC GCCGGGAAAA |
| SEQ ID 2203 | QVQLQESGGGLVQPGGSLRLSCAASG FTFSSYAMSWVRQAPGKGLEWVSAIS GSGGSTYYADSVKGRFTISRDNSKNTL YLQMNSLRAEDTAVYYCAKGGMYYY GSGSSYFDYWGQGTLVTVSSASTKGPS VFPLAPSSKSTSGGTAALGCLVKDYFP EPVTVSWNSGALTSGVHTFPAVLQSSG LYSLSSVVTVPSSSLGTQTYICNVNHKP SNTKVDKKVEPKSCDKTHTCPPCPAPE LLGGPSVFLFPPKPKDTLMISRTPEVTC VVVDVSHEDPEVKFNWYVDGVEVHN AKTKPREEQYASTYRVVSVLTVLHQD WLNGKEYKCKVSNKALPAPIEKTISKA KGQPREPQVYTLPPSREEMTKNQVSLT CLVKGFYPSDIAVEWESNGQPENNYK TTPPVLDSDGSFFLYSKLTVDKSRWQQ GNVFSCSVMHEALHNHYTQKSLSLSP GK | SEQ ID 2311 | CAGGTGCAGCTGCAGGAGTCGGGG GGAGGCTTGGTACAGCCTGGGGGGT CCCTGAGACTCTCCTGTGCAGCCTC TGGATTCACCTTTAGCAGCTATGCC ATGAGCTGGGTCCGCCAGGCTCCAG GGAAGGGGCTGGAGTGGGTCTCAG CTATTAGTGGTAGTGGTGGTAGCAC ATACTACGCAGACTCCGTGAAGGGC CGGTTCACCATCTCCAGAGACAATT CCAAGAACACGCTGTATCTGCAAAT GAACAGCCTGAGAGCCGAGGACAC GGCCGTATATTACTGTGCGAAAGGA GGAATGTATTACTATGGTTCGGGGA GCTCGTACTTTGACTACTGGGGCCA GGGAACCCTGGTGACCGTCTCCTCA GCATCCACCAAGGGGCCTTCCGTGT TCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2204 | QVQLVQSGGGLVQPGGSLRLSCAASG FTFSSYAMSWVRQAPGKGLEWVSGIS GSGGSTYYADSVKGRFTISRDNSKNM LFLQMNSPRAEDTAVYYCAKKIAAAG KQPVDYWGQGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC | SEQ ID 2312 | CAGGTGCAGCTGGTGCAATCTGGGG GAGGCTTGGTACAGCCTGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAATGGGTCTCAGGT ATTAGTGGTAGTGGTGGTAGCACAT ACTACGCAGACTCCGTGAAGGGCCG GTTCACCATCTCCAGAGACAATTCC AAGAACATGCTGTTTCTGCAAATGA ACAGCCCGAGAGCCGAGGACACGG CCGTATATTACTGTGCGAAGAAAAT AGCAGCAGCTGGTAAGCAACCTGTT GACTACTGGGGCCAGGGAACCCTGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | LVKGFYPSDIAVEWESNGQPENNYKT TPPVLDSDGSFFLYSKLTVDKSRWQQG NVFSCSVMHEALHNHYTQKSLSLSPG K | | TCACCGTCTCCTCAGCATCCACCAA GGGGCCTTCCGTGTTCCCCCTGGCC CCTTCATCCAAGTCGACCTCTGGTG GAACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC AAGCCCTCCAACACCAAAGTGGACA AGAAGGTCGAACCCAAGTCCTGCGA CAAGACTCACACCTGTCCGCCTTGT CCAGCCCTGAGCTGCTGGGTGGTC CGTCCGTGTTCCTCTTCCCGCCCAAG CCGAAGGACACTCTGATGATTTCAC GCACCCCGGAAGTCACTTGCGTGGT CGTGGACGTGTCGCACGAAGATCCC GAAGTGAAATTCAATTGGTACGTGG ATGGGGTCGAAGTGCACAACGCCA AGACCAAGCCTAGGGAAGAACAGT ACgccTCTACGTACCGGGTGGTGTCC GTGCTGACCGTGCTGCACCAGGACT GGCTGAACGGAAAGGAGTACAAGT GCAAAGTGTCAAACAAGGCTCTCCC TGCCCCTATCGAAAAGACCATCAGC AAGGCCAAGGGTCAACCTAGGGAG CCCCAGGTCTACACTTTGCCGCCTA GCCGGGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCAAGCTGACT GTGGACAAGTCAAGATGGCAGCAG GGAAACGTGTTCTCCTGCTCCGTGA TGCACGAAGCGCTGCACAACCATTA CACCCAGAAATCACTGTCACTTTCG CCGGGAAAA |
| SEQ ID 2205 | QVQLQQWGAGLLKPSETLSLTCAVYG GSFSGYYWSWIRQPPGKGLEWIGEINH SGSTNYNPSLKSRVTISVDTSKNQFSLK LSSVTAADTAVYYCARRKVYDYVWG SYRLPGSVSYYFDYWGQGTLVTVSSA STKGPSVFPLAPSSKSTSGGTAALGCL VKDYFPEPVTVSWNSGALTSGVHTFP AVLQSSGLYSLSSVVTVPSSSLGTQTYI CNVNHKPSNTKVDKKVEPKSCDKTHT CPPCPAPELLGGPSVFLFPPKPKDTLMI SRTPEVTCVVVDVSHEDPEVKFNWYV DGVEVHNAKTKPREEQYASTYRVVSV LTVLHQDWLNGKEYKCKVSNKALPAP IEKTISKAKGQPREPQVYTLPPSREEMT KNQVSLTCLVKGFYPSDIAVEWESNG QPENNYKTTPPVLDSDGSFFLYSKLTV DKSRWQQGNVFSCSVMHEALHNHYT QKSLSLSPGK | SEQ ID 2313 | CAGGTGCAGCTACAGCAGTGGGGC GCAGGACTGTTGAAGCCTTCGGAGA CCCTGTCCCTCACCTGCGCTGTCTAT GGTGGCTCCTTCAGTGGTTACTACT GGAGCTGGATCCGCCAGCCCCCAGG GAAGGGGCTGGAGTGGATTGGGGA AATCAATCATAGTGGAAGCACCAAC TACAACCCGTCCCTCAAGAGTCGAG TCACCATATCAGTAGACACGTCCAA GAACCAGTTCTCCCTGAAGCTGAGC TCTGTGACCGCCGCGGACACGGCTG TGTATTACTGTGCGAGAAGGAAGGT GTATGATTACGTTTGGGGGAGTTAT CGCCTCCCCGGGTCGGTATCGTACT ACTTTGACTACTGGGGCCAGGGAAC CCTGGTCACCGTCTCCTCAGCATCC ACCAAGGGGCCTTCCGTGTTCCCCC TGGCCCCTTCATCCAAGTCGACCTC TGGTGGAACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCCAGACCTATATCTGCAACGTCA ATCACAAGCCCTCCAACACCAAAGT GGACAAGAAGGTCGAACCCAAGTC CTGCGACAAGACTCACACCTGTCCG CCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCACGAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GATCCCGAAGTGAAATTCAATTGGT ACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2206 | QVQLVQSGAEVKKPGESLKISCKGSGY SFTSYWIGWVRQMPGKGLEWMGIIYP GDSDTRYSPSFQGQVTISADKSISTAYL QWSSLKASDTAMYYCARLPGRAARPD YWGQGTLVTVSSASTKGPSVFPLAPSS KSTSGGTAALGCLVKDYFPEPVTVSW NSGALTSGVHTFPAVLQSSGLYSLSSV VTVPSSSLGTQTYICNVNHKPSNTKVD KKVEPKSCDKTHTCPPCPAPELLGGPS VFLFPPKPKDTLMISRTPEVTCVVVDV SHEDPEVKFNWYVDGVEVHNAKTKP REEQYASTYRVVSVLTVLHQDWLNGK EYKCKVSNKALPAPIEKTISKAKGQPR EPQVYTLPPSREEMTKNQVSLTCLVKG FYPSDIAVEWESNGQPENNYKTTPPVL DSDGSFFLYSKLTVDKSRWQQGNVFS CSVMHEALHNHYTQKSLSLSPGK | SEQ ID 2314 | CAGGTCCAGCTGGTACAGTCTGGAG CAGAGGTGAAAAAGCCCGGGGAGT CTCTGAAGATCTCCTGTAAGGGTTC TGGATACAGCTTTACCAGCTACTGG ATCGGCTGGGTGCGCCAGATGCCCG GGAAAGGCCTGGAGTGGATGGGGA TCATCTATCCTGGTGACTCTGATACC AGATACAGCCCGTCCTTCCAAGGCC AGGTCACCATCTCAGCCGACAAGTC CATCAGCACCGCCTACCTGCAGTGG AGCAGCCTGAAGGCCTCGGACACCG CCATGTATTACTGTGCGAGACTCCC GGGGAGAGCAGCTCGTCCAGACTAC TGGGGCCAGGGCACCCTGGTCACCG TCTCCTCAGCATCCACCAAGGGGCC TTCCGTGTTCCCCCTGGCCCCTTCAT CCAAGTCGACCTCTGGTGGAACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCCAGACCTAT ATCTGCAACGTCAATCACAAGCCCT CCAACACCAAAGTGGACAAGAAGG TCGAACCCAAGTCCTGCGACAAGAC TCACACCTGTCCGCCTTGTCCAGCC CCTGAGCTGCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCACGAAGATCCCGAAGT GAAATTCAATTGGTACGTGGATGGG GTCGAAGTGCACAACGCCAAGACC AAGCCTAGGGAAGAACAGTACgccT CTACGTACCGGGTGGTGTCCGTGCT GACCGTGCTGCACCAGGACTGGCTG AACGGAAAGGAGTACAAGTGCAAA GTGTCAAACAAGGCTCTCCCTGCCC CTATCGAAAAGACCATCAGCAAGGC CAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AGCGCTGCACAACCATTACACCCAG AAATCACTGTCACTTTCGCCGGGAA AA |
| SEQ ID 2207 | QVTLKESGGGVVQPGRSLRLSCAASGF TFSSYAMHWVRQAPGKGLEWVAVISY DGSNKYYADSVKGRFTISRDNSKNTL YLQMNSLRAEDTAVYYCARGPGAVA GTKPKYYFDYWGQGTLVTVSSASTKG PSVFPLAPSSKSTSGGTAALGCLVKDY FPEPVTVSWNSGALTSGVHTFPAVLQS SGLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2315 | CAGGTCACCTTGAAGGAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGAGGCCC CGGGGCAGTGGCTGGTACTAAGCCA AAGTACTACTTTGACTACTGGGGCC AGGGAACCCTGGTCACCGTCTCCTC AGCATCCACCAAGGGGCCTTCCGTG TTCCCCCTGGCCCCTTCATCCAAGTC GACCTCTGGTGAACCGCCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2208 | EVQLVQSGGGVVQPGRSLRLSCAASG FTFSSYAMHWVRQAPGKGLEWVAVIS YDGSNKYYADSVKGRFTISRDNSKNT LYLQMNSLRAEDTAVYYCARATYYY DSSGYRFDYWGQGTLVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV | SEQ ID 2316 | GAGGTCCAGCTGGTGCAGTCTGGGG GAGGCGTGGTCCAGCCTGGGAGGTC CCTGAGACTCTCCTGTGCAGCCTCT GGATTCACCTTCAGTAGCTATGCTA TGCACTGGGTCCGCCAGGCTCCAGG CAAGGGGCTGGAGTGGGTGGCAGTT ATATCATATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGGGCCAC GTATTACTATGATAGTAGTGGTTAT AGGTTTGACTACTGGGGCCAGGGAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | SLTCLVKGFYPSDIAVEWESNGQPENN YKTTPPVLDSDGSFFLYSKLTVDKSRW QQGNVFSCSVMHEALHNHYTQKSLSL SPGK | | CCCTGGTCACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2209 | EVQLVQSGGGLVEPGGSLRLSCAASRF TFSDAWMSWVRQAPGKGLEWVGRIK SKISGGTTDYAAPVQGRFTISRDDSKN TLYLQMDSLKTEDTAVYYCNRNLGY WGQGTLVTVSSASTKGPSVFPLAPSSK STSGGTAALGCLVKDYFPEPVTVSWN SGALTSGVHTFPAVLQSSGLYSLSSVV TVPSSSLGTQTYICNVNHKPSNTKVDK KVEPKSCDKTHTCPPCPAPELLGGPSV FLFPPKPKDTLMISRTPEVTCVVVDVS HEDPEVKFNWYVDGVEVHNAKTKPR EEQYASTYRVVSVLTVLHQDWLNGKE YKCKVSNKALPAPIEKTISKAKGQPRE PQVYTLPPSREEMTKNQVSLTCLVKGF YPSDIAVEWESNGQPENNYKTTPPVLD SDGSFFLYSKLTVDKSRWQQGNVFSCS VMHEALHNHYTQKSLSLSPGK | SEQ ID 2317 | GAGGTCCAGCTGGTACAGTCTGGGG GAGGCTTGGTAGAACCGGGGGGGT CCCTTAGACTCTCCTGTGCAGCCTCT CGATTCACTTTCAGTGACGCCTGGA TGAGCTGGGTCCGCCAGGCTCCAGG TAAGGGGCTGGAGTGGGTTGGCCGT ATTAAAAGCAAAATAAGTGGTGGG ACAACAGACTACGCTGCACCCGTGC AAGGCAGATTCACCATCTCAAGAGA TGATTCAAAAAACACGCTGTATCTG CAAATGGACAGCCTGAAAACCGAG GACACAGCCGTGTATTACTGTGCGA ACCGAAACTTAGGCTACTGGGGCCA GGGCACCCTGGTGACCGTCTCCTCA GCATCCACCAAGGGGCCTTCCGTGT TCCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2210 | EVQLVQSGAEVKKPGASVKVSCKASG YTFTSYAMHWVRQAPGQRLEWMGWI NAGNGNTKYSQKFQGRVTMTTDTSTS TAYMELRSLRSDDTAVYYCARARYYD SSGYIAPSGYFDYWGQGTLVTVSSAST KGPSVFPLAPSSKSTSGGTAALGCLVK DYFPEPVTVSWNSGALTSGVHTFPAVL QSSGLYSLSSVVTVPSSSLGTQTYICNV NHKPSNTKVDKKVEPKSCDKTHTCPP CPAPELLGGPSVFLFPPKPKDTLMISRT PEVTCVVVDVSHEDPEVKFNWYVDG VEVHNAKTKPREEQYASTYRVVSVLT VLHQDWLNGKEYKCKVSNKALPAPIE KTISKAKGQPREPQVYTLPPSREEMTK NQVSLTCLVKGFYPSDIAVEWESNGQP ENNYKTTPPVLDSDGSFFLYSKLTVDK SRWQQGNVFSCSVMHEALHNHYTQK SLSLSPGK | SEQ ID 2318 | GAGGTCCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AATATTCACAGAAGTTCCAGGGCA GAGTCACCATGACCACAGACACATC CACGAGCACAGCCTACATGGAGCTG AGGAGCCTGAGATCTGACGACACG GCCGTGTATTACTGTGCGAGAGCTC GTTACTATGATAGTAGTGGTTATAT TGCCCCATCGGGTTACTTTGACTACT GGGGCCAGGGAACCCTGGTCACCGT CTCCTCAGCATCCACCAAGGGGCCT TCCGTGTTCCCCCTGGCCCCTTCATC CAAGTCGACCTCTGGTGGAACCGCC GCACTCGGTTGCCTGGTCAAAGACT ACTTCCCCGAGCCCGTGACTGTCTC GTGGAACTCGGGCGCCCTCACATCC GGAGTGCATACCTTTCCCGCCGTGT TGCAGTCCAGCGGCCTGTACAGCCT GAGCTCCGTCGTGACAGTGCCGTCC TCCTCCCTTGGAACCCAGACCTATA TCTGCAACGTCAATCACAAGCCCTC CAACACCAAAGTGGACAAGAAGGT CGAACCCAAGTCCTGCGACAAGACT CACACCTGTCCGCCTTGTCCAGCCC CTGAGCTGCTGGGTGGTCCGTCCGT GTTCCTCTTCCCGCCCAAGCCGAAG GACACTCTGATGATTTCACGCACCC CGGAAGTCACTTGCGTGGTCGTGGA CGTGTCGCACGAAGATCCCGAAGTG AAATTCAATTGGTACGTGGATGGGG TCGAAGTGCACAACGCCAAGACCA AGCCTAGGGAAGAACAGTACgccTCT ACGTACCGGGTGGTGTCCGTGCTGA CCGTGCTGCACCAGGACTGGCTGAA CGGAAAGGAGTACAAGTGCAAAGT GTCAAACAAGGCTCTCCCTGCCCCT ATCGAAAAGACCATCAGCAAGGCC AAGGGTCAACCTAGGGAGCCCCAG GTCTACACTTTGCCGCCTAGCCGGG AAGAAATGACTAAGAACCAAGTGT CCCTGACTTGCCTTGTCAAGGGCTTT TATCCGTCCGACATCGCCGTGGAGT GGGAGTCCAACGGACAACCGGAGA ACAACTACAAGACCACCCCACCGGT GCTCGATTCCGATGGCTCCTTCTTCC TGTACTCCAAGCTGACTGTGGACAA GTCAAGATGGCAGCAGGGAAACGT GTTCTCCTGCTCCGTGATGCACGAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GCGCTGCACAACCATTACACCCAGA<br>AATCACTGTCACTTTCGCCGGGAAA<br>A |
| SEQ ID<br>2211 | QVQLVQSGAEVKKPGASVKVSCKASG<br>YTFTSYAMHWVRQAPGQRLEWMGWI<br>NAGNGNTKYSQKFQGRVTITRDTSAST<br>AYMELSSLRSEDTAVYYCARDGPAVD<br>GAEYFQHWGQGTLVTVSSASTKGPSV<br>FPLAPSSKSTSGGTAALGCLVKDYFPE<br>PVTVSWNSGALTSGVHTFPAVLQSSGL<br>YSLSSVVTVPSSSLGTQTYICNVNHKPS<br>NTKVDKKVEPKSCDKTHTCPPCPAPEL<br>LGGPSVFLFPPKPKDTLMISRTPEVTCV<br>VVDVSHEDPEVKFNWYVDGVEVHNA<br>KTKPREEQYASTYRVVSVLTVLHQDW<br>LNGKEYKCKVSNKALPAPIEKTISKAK<br>GQPREPQVYTLPPSREEMTKNQVSLTC<br>LVKGFYPSDIAVEWESNGQPENNYKT<br>TPPVLDSDGSFFLYSKLTVDKSRWQQG<br>NVFSCSVMHEALHNHYTQKSLSLSPG<br>K | SEQ ID<br>2319 | CAGGTGCAGCTGGTGCAGTCTGGGG<br>CTGAGGTGAAGAAGCCTGGGGCCTC<br>AGTGAAGGTTTCCTGCAAGGCTTCT<br>GGATACACCTTCACTAGCTATGCTA<br>TGCATTGGGTGCGCCAGGCCCCCGG<br>ACAAAGGCTTGAGTGGATGGGATG<br>GATCAACGCTGGCAATGGTAACACA<br>AAATATTCACAGAAGTTCCAGGGCA<br>GAGTCACCATTACCAGGGACACATC<br>CGCGAGCACAGCCTACATGGAGCTG<br>AGCAGCCTGAGATCTGAAGACACG<br>GCTGTGTATTACTGTGCGAGAGATG<br>GCCCCGCCGTTGATGGTGCTGAATA<br>CTTCCAGCACTGGGGCCAGGGCACC<br>CTGGTCACCGTCTCCTCAGCATCCA<br>CCAAGGGGCCTTCCGTGTTCCCCCT<br>GGCCCCTTCATCCAAGTCGACCTCT<br>GGTGAACCGCCGCACTCGGTTGCC<br>TGGTCAAAGACTACTTCCCCGAGCC<br>CGTGACTGTCTCGTGGAACTCGGGC<br>GCCCTCACATCCGGAGTGCATACCT<br>TTCCCGCCGTGTTGCAGTCCAGCGG<br>CCTGTACAGCCTGAGCTCCGTCGTG<br>ACAGTGCCGTCCTCCTCCCCTTGGAA<br>CCCAGACCTATATCTGCAACGTCAA<br>TCACAAGCCCTCCAACACCAAAGTG<br>GACAAGAAGGTCGAACCCAAGTCCT<br>GCGACAAGACTCACACCTGTCCGCC<br>TTGTCCAGCCCCTGAGCTGCTGGGT<br>GGTCCGTCCGTGTTCCTCTTCCCGCC<br>CAAGCCGAAGGACACTCTGATGATT<br>TCACGCACCCCGGAAGTCACTTGCG<br>TGGTCGTGGACGTGTCGCACGAAGA<br>TCCCGAAGTGAAATTCAATTGGTAC<br>GTGGATGGGGTCGAAGTGCACAAC<br>GCCAAGACCAAGCCTAGGGAAGAA<br>CAGTACgccTCTACGTACCGGGTGGT<br>GTCCGTGCTGACCGTGCTGCACCAG<br>GACTGGCTGAACGGAAAGGAGTAC<br>AAGTGCAAAGTGTCAAACAAGGCTC<br>TCCCTGCCCCATCGAAAAGACCAT<br>CAGCAAGGCCAAGGGTCAACCTAG<br>GGAGCCCCAGGTCTACACTTTGCCG<br>CCTAGCCGGGAAGAAATGACTAAG<br>AACCAAGTGTCCCTGACTTGCCTTG<br>TCAAGGGCTTTTATCCGTCCGACAT<br>CGCCGTGGAGTGGGAGTCCAACGG<br>ACAACCGGAGAACAACTACAAGAC<br>CACCCCACCGGTGCTCGATTCCGAT<br>GGCTCCTTCTTCCTGTACTCCAAGCT<br>GACTGTGGACAAGTCAAGATGGCA<br>GCAGGGAAACGTGTTCTCCTGCTCC<br>GTGATGCACGAAGCGCTGCACAACC<br>ATTACACCCAGAAATCACTGTCACT<br>TTCGCCGGGAAA |
| SEQ ID<br>2212 | QLQLQESGPGLVKPSQTLSLTCAISGDS<br>VSSNSAAWNWIRQSPSRGLEWLGRTY<br>YRSKWYNDYAVSLKSRITINPDTSKNQ<br>FSLQLNSVTPEDTAVYYCASLASGSPP<br>PGDYWGQGTLVTVSSASTKGPSVFPL<br>APSSKSTSGGTAALGCLVKDYFPEPVT<br>VSWNSGALTSGVHTFPAVLQSSGLYSL<br>SSVVTVPSSSLGTQTYICNVNHKPSNT<br>KVDKKVEPKSCDKTHTCPPCPAPELLG<br>GPSVFLFPPKPKDTLMISRTPEVTCVVV<br>DVSHEDPEVKFNWYVDGVEVHNAKT<br>KPREEQYASTYRVVSVLTVLHQDWLN<br>GKEYKCKVSNKALPAPIEKTISKAKGQ | SEQ ID<br>2320 | CAGCTGCAGCTGCAGGAGTCGGGTC<br>CAGGACTGGTGAAGCCCTCGCAGAC<br>CCTCTCACTCACCTGTGCCATCTCCG<br>GGGACAGTGTCTCTAGCAACAGTGC<br>TGCTTGGAACTGGATCAGGCAGTCC<br>CCATCGCGAGGCCTTGAGTGGCTGG<br>GAAGGACTTACTACAGGTCCAAGTG<br>GTATAATGATTATGCAGTATCTCTG<br>AAAAGTCGAATAACCATCAACCCGG<br>ACACATCCAAGAACCAGTTCTCCCT<br>GCAGCTGAACTCTGTGACTCCCGAG<br>GACACGGCTGTATATTACTGTGCAA<br>GTTTGGCGAGTGGTTCCCCCCCTCC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | | GGGGGACTACTGGGGCCAGGGAAC CCTGGTGACCGTCTCCTCAGCATCC ACCAAGGGGCCTTCCGTGTTCCCCC TGGCCCCTTCATCCAAGTCGACCTC TGGTGGAACCGCCGCACTCGGTTGC CTGGTCAAAGACTACTTCCCCGAGC CCGTGACTGTCTCGTGGAACTCGGG CGCCCTCACATCCGGAGTGCATACC TTTCCCGCCGTGTTGCAGTCCAGCG GCCTGTACAGCCTGAGCTCCGTCGT GACAGTGCCGTCCTCCTCCCTTGGA ACCCAGACCTATATCTGCAACGTCA ATCACAAGCCCTCCAACACCAAAGT GGACAAGAAGGTCGAACCCAAGTC CTGCGACAAGACTCACACCTGTCCG CCTTGTCCAGCCCCTGAGCTGCTGG GTGGTCCGTCCGTGTTCCTCTTCCCG CCCAAGCCGAAGGACACTCTGATGA TTTCACGCACCCCGGAAGTCACTTG CGTGGTCGTGGACGTGTCGCACGAA GATCCCGAAGTGAAATTCAATTGGT ACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2213 | QVTLKESGGGVVQPGRSLRLSCAASGF TFSTYGMHWVRQAPGKGLEWVALISY DGSKKYYANSVKGRFTISRDNSKNTL YLQMKSLRAEDTAMYYCAKGPIVGAT MDYWGQGALVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2321 | CAGGTCACCTTGAAGGAGTCTGGGG GAGGCGTGGTCCAGCCTGGGAGGTC CCTGAGACTCTCCTGTGCAGCCTCT GGATTCACCTTCAGTACCTATGGCA TGCACTGGGTCCGCCAGGCTCCAGG CAAGGGGCTGGAGTGGGTGGCACTT ATATCATATGATGGAAGTAAAAAAT ACTATGCAAACTCCGTGAAGGGCCG ATTCACCATCTCCAGAGACAATTCC AAGAACACGTTGTATCTGCAAATGA AAAGTCTGAGAGCTGAGGACACGG CTATGTATTACTGTGCGAAAGGCCC TATAGTGGGAGCGACTATGGACTAC TGGGGCCAGGGAGCCCTGGTCACCG TCTCCTCAGCATCCACCAAGGGCCC ATCGGTCTTCCCCCTGGCCCCTTCAT CCAAGTCGACCTCTGGTGGAACCGC CGCACTCGGTTGCCTGGTCAAAGAC TACTTCCCCGAGCCCGTGACTGTCT CGTGGAACTCGGGCGCCCTCACATC CGGAGTGCATACCTTTCCCGCCGTG TTGCAGTCCAGCGGCCTGTACAGCC TGAGCTCCGTCGTGACAGTGCCGTC CTCCTCCCTTGGAACCCAGACCTAT ATCTGCAACGTCAATCACAAGCCCT CCAACACCAAAGTGGACAAGAAGG TCGAACCCAAGTCCTGCGACAAGAC TCACACCTGTCCGCCTTGTCCAGCC CCTGAGCTGCTGGGTGGTCCGTCCG TGTTCCTCTTCCCGCCCAAGCCGAA GGACACTCTGATGATTTCACGCACC CCGGAAGTCACTTGCGTGGTCGTGG ACGTGTCGCACGAAGATCCCGAAGT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GAAATTCAATTGGTACGTGGATGGG GTCGAAGTGCACAACGCCAAGACC AAGCCTAGGGAAGAACAGTACgccT CTACGTACCGGGTGGTGTCCGTGCT GACCGTGCTGCACCAGGACTGGCTG AACGGAAAGGAGTACAAGTGCAAA GTGTCAAACAAGGCTCTCCCTGCCC CTATCGAAAAGACCATCAGCAAGGC CAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2214 | EVQLVQSGAEVKKPGSSVKVSCKASG GTFSSYAISWVRQAPGQGLEWMGWIS AYNGNTNYAQKLQGRVTMTTDTSTST AYMELRSLRSDDTAVYYCARWYGDY GLDYWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2322 | GAGGTGCAGCTGGTGCAGTCTGGGG CTGAGGTGAAGAAGCCTGGGTCCTC GGTGAAGGTCTCCTGCAAGGCTTCT GGAGGCACCTTCAGCAGCTATGCTA TCAGCTGGGTGCGACAGGCCCCTGG ACAAGGGCTTGAGTGGATGGGATG GATCAGCGCTTACAATGGTAACACA AACTATGCACAGAAGCTCCAGGGCA GAGTCACCATGACCACAGACACATC CACGAGCACAGCCTACATGGAGCTG AGGAGCCTGAGATCTGACGACACG GCCGTGTATTACTGTGCGAGATGGT ACGGTGACTACGGCCTTGACTACTG GGGCCAGGGAACCCTGGTCACCGTC TCCTCAGCTAGCACCAAGGGGCCTT CCGTGTTCCCCCTGGCCCCTTCATCC AAGTCGACCTCTGGTGGAACCGCCG CACTCGGTTGCCTGGTCAAAGACTA CTTCCCCGAGCCCGTGACTGTCTCG TGGAACTCGGGCGCCCTCACATCCG GAGTGCATACCTTTCCCGCCGTGTT GCAGTCCAGCGGCCTGTACAGCCTG AGCTCCGTCGTGACAGTGCCGTCCT CCTCCCTTGGAACCCAGACCTATAT CTGCAACGTCAATCACAAGCCCTCC AACACCAAAGTGGACAAGAAGGTC GAACCCAAGTCCTGCGACAAGACTC ACACCTGTCCGCCTTGTCCAGCCCC TGAGCTGCTGGGTGGTCCGTCCGTG TTCCTCTTCCCGCCCAAGCCGAAGG ACACTCTGATGATTTCACGCACCCC GGAAGTCACTTGCGTGGTCGTGGAC GTGTCGCACGAAGATCCCGAAGTGA AATTCAATTGGTACGTGGATGGGGT CGAAGTGCACAACGCCAAGACCAA GCCTAGGGAAGAACAGTACgccTCTA CGTACCGGGTGGTGTCCGTGCTGAC CGTGCTGCACCAGGACTGGCTGAAC GGAAAGGAGTACAAGTGCAAAGTG TCAAACAAGGCTCTCCCTGCCCCTA TCGAAAAGACCATCAGCAAGGCCA AGGGTCAACCTAGGGAGCCCCAGGT CTACACTTTGCCGCCTAGCCGGGAA GAAATGACTAAGAACCAAGTGTCCC TGACTTGCCTTGTCAAGGGCTTTTAT CCGTCCGACATCGCCGTGGAGTGGG AGTCCAACGGACAACCGGAGAACA ACTACAAGACCACCCCACCGGTGCT CGATTCCGATGGCTCCTTCTTCCTGT ACTCCAAGCTGACTGTGGACAAGTC AAGATGGCAGCAGGGAAACGTGTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CTCCTGCTCCGTGATGCACGAAGCG CTGCACAACCATTACACCCAGAAAT CACTGTCACTTTCGCCGGGAAAA |
| SEQ ID 2215 | EVQLVQSGAEVKKPGASVKVSCKASG YTFTSYAMHWVRQAPGQRLAWMGWI NAGNGNTKYSEKFEGRVTITRDTSAST AYMELSSLRSEDTAVYYCARVAKYYY ESGGYRASNWFDPWGQGTLVTVSSAS TKGPSVFPLAPSSKSTSGGTAALGCLV KDYFPEPVTVSWNSGALTSGVHTFPA VLQSSGLYSLSSVVTVPSSSLGTQTYIC NVNHKPSNTKVDKKVEPKSCDKTHTC PPCPAPELLGGPSVFLFPPKPKDTLMIS RTPEVTCVVVDVSHEDPEVKFNWYVD GVEVHNAKTKPREEQYASTYRVVSVL TVLHQDWLNGKEYKCKVSNKALPAPI EKTISKAKGQPREPQVYTLPPSREEMT KNQVSLTCLVKGFYPSDIAVEWESNG QPENNYKTTPPVLDSDGSFFLYSKLTV DKSRWQQGNVFSCSVMHEALHNHYT QKSLSLSPGK | SEQ ID 2323 | GAGGTCCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGCGTGGATGGGATGG ATCAACGCTGGCAATGGTAACACAA AATATTCAGAAGTTCGAAGGCAG AGTCACCATCACCAGGGACACATCC GCGAGCACAGCCTACATGGAGCTGA GCAGCCTGAGATCTGAAGACACGGC TGTGTATTACTGTGCGAGGGTCGCC AAATATTATTACGAGAGTGGTGGTT ATCGGGCCTCCAACTGGTTCGACCC CTGGGGCCAGGGCACCCTGGTCACC GTCTCCTCAGCATCCACCAAGGGGC CTTCCGTGTTCCCCCTGGCCCCTTCA TCCAAGTCGACCTCTGGTGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG GGTCGAAGTGCACAACGCCAAGAC CAAGCCTAGGGAAGAACAGTACgcc TCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2216 | QVQLQESGPGLVKPSQTLSLTCAISGD SVSSNSAAWNWIRQSPSRGLEWLGRT YYRSKWYNDYAVSVKSRITINPDTSKN QFSLQLNSVTPEDTAVYYCARAPPPTV GWYAPVFDYWGQGTLVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV | SEQ ID 2324 | CAGGTGCAGCTGCAGGAGTCAGGTC CAGGACTGGTGAAGCCCTCGCAGAC CCTCTCACTCACCTGTGCCATCTCCG GGGACAGTGTCTCTAGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGCTGAACTCTGTGACTCCCGAG GACACGGCTGTGTATTACTGTGCAA GAGCGCCCCCTCCGACTGTTGGCTG GTACGCCCCCGTCTTTGACTACTGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | SLTCLVKGFYPSDIAVEWESNGQPENN YKTTPPVLDSDGSFFLYSKLTVDKSRW QQGNVFSCSVMHEALHNHYTQKSLSL SPGK | | GGCCAGGGAACCCTGGTCACCGTCT CCTCAGCATCCACCAAGGGGCCTTC CGTGTTCCCCCTGGCCCCTTCATCCA AGTCGACCTCTGGTGGAACCGCCGC ACTCGGTTGCCTGGTCAAAGACTAC TTCCCCGAGCCCGTGACTGTCTCGT GGAACTCGGGCGCCCTCACATCCGG AGTGCATACCTTTCCCGCCGTGTTG CAGTCCAGCGGCCTGTACAGCCTGA GCTCCGTCGTGACAGTGCCGTCCTC CTCCCTTGGAACCCAGACCTATATC TGCAACGTCAATCACAAGCCCTCCA ACACCAAAGTGGACAAGAAGGTCG AACCCAAGTCCTGCGACAAGACTCA CACCTGTCCGCCTTGTCCAGCCCCT GAGCTGCTGGGTGGTCCGTCCGTGT TCCTCTTCCCGCCCAAGCCGAAGGA CACTCTGATGATTTCACGCACCCCG GAAGTCACTTGCGTGGTCGTGGACG TGTCGCACGAAGATCCCGAAGTGAA ATTCAATTGGTACGTGGATGGGGTC GAAGTGCACAACGCCAAGACCAAG CCTAGGGAAGAACAGTACgccTCTAC GTACCGGGTGGTGTCCGTGCTGACC GTGCTGCACCAGGACTGGCTGAACG GAAAGGAGTACAAGTGCAAAGTGT CAAACAAGGCTCTCCCTGCCCCTAT CGAAAAGACCATCAGCAAGGCCAA GGGTCAACCTAGGGAGCCCCAGGTC TACACTTTGCCGCCTAGCCGGGAAG AAATGACTAAGAACCAAGTGTCCCT GACTTGCCTTGTCAAGGGCTTTTATC CGTCCGACATCGCCGTGGAGTGGGA GTCCAACGGACAACCGGAGAACAA CTACAAGACCACCCCACCGGTGCTC GATTCCGATGGCTCCTTCTTCCTGTA CTCCAAGCTGACTGTGGACAAGTCA AGATGGCAGCAGGGAAACGTGTTCT CCTGCTCCGTGATGCACGAAGCGCT GCACAACCATTACACCCAGAAATCA CTGTCACTTTCGCCGGGAAAA |
| SEQ ID 2217 | QLQLQESGGGLVQPGGSLRLSCSASGI SFRDYWMHWIRQTPGKGLVWVSRINP DGSSTSYADSVKGRFTISRDNSKNTLY LQMNSLRAEDTAVYYCAKVTGRRVG AHDYWGQGTLVTVSSASTKGPSVFPL APSSKSTSGGTAALGCLVKDYFPEPVT VSWNSGALTSGVHTFPAVLQSSGLYSL SSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV KGFYPSDIAVEWESNGQPENNYKTTPP VLDSDGSFFLYSKLTVDKSRWQQGNV FSCSVMHEALHNHYTQKSLSLSPGK | SEQ ID 2325 | CAGCTGCAGCTGCAGGAGTCCGGGG GAGGCTTAGTTCAGCCGGGGGGGTC CCTGAGACTCTCCTGCTCAGCCTCT GGAATCAGCTTCAGAGATTACTGGA TGCACTGGATCCGCCAAACTCCAGG GAAGGGGCTGGTGTGGGTCTCACGT ATTAATCCTGATGGGAGTAGCACAA GCTACGCGGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAAAGTTAC GGGACGGAGAGTGGGAGCCCATGA CTACTGGGGCCAGGGAACCCTGGTC ACCGTCTCCTCAGCATCCACCAAGG GGCCTTCCGTGTTCCCCCTGGCCCCT TCATCCAAGTCGACCTCTGGTGGAA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCCAGAC CTATATCTGCAACGTCAATCACAAG CCCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC CCCTATCGAAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA CGTGTTCTCCTGCTCCGTGATGCAC GAAGCGCTGCACAACCATTACACCC AGAAATCACTGTCACTTTCGCCGGG AAAA |
| SEQ ID 2218 | QVQLVQSGAEVKKPGASVKVSCKASG YTFTGYYMHWVRQAPGQGLEWMGW INPNSGGTNYAQKFQGRVTMTRDTSIS TAYMELSRLRSDDTAVYYCAFAQPGA ETLNFDLWGRGTLVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2326 | CAGGTGCAGCTGGTGCAGTCTGGGG CTGAGGTGAAGAAGCCTGGGGCCTC AGTGAAGGTCTCCTGCAAGGCTTCT GGATACACCTTCACCGGCTACTATA TGCACTGGGTGCGACAGGCCCCTGG ACAAGGGCTTGAGTGGATGGGATG GATCAACCCTAACAGTGGTGGCACA AACTATGCACAGAAGTTTCAGGGCA GGGTCACCATGACCAGGGACACGTC CATCAGCACAGCCTACATGGAGCTG AGCAGGCTGAGATCTGACGACACG GCCGTGTATTACTGTGCCTTTGCCCA GCCGGGCGCTGAGACGTTGAACTTC GATCTCTGGGGCCGTGGCACCCTGG TCACCGTCTCCTCAGCATCCACCAA GGGGCCTTCCGTGTTCCCCCTGCC CCTTCATCCAAGTCGACCTCTGGTG GAACCGCCGCACTCGGTTGCCTGGT CAAAGACTACTTCCCCGAGCCCGTG ACTGTCTCGTGGAACTCGGGCGCCC TCACATCCGGAGTGCATACCTTTCC CGCCGTGTTGCAGTCCAGCGGCCTG TACAGCCTGAGCTCCGTCGTGACAG TGCCGTCCTCCTCCCTTGGAACCCA GACCTATATCTGCAACGTCAATCAC AAGCCCTCCAACACCAAAGTGGACA AGAAGGTCGAACCCAAGTCCTGCGA CAAGACTCACACCTGTCCGCCTTGT CCAGCCCCTGAGCTGCTGGGTGGTC CGTCCGTGTTCCTCTTCCCGCCCAAG CCGAAGGACACTCTGATGATTTCAC GCACCCCGGAAGTCACTTGCGTGGT CGTGGACGTGTCGCACGAAGATCCC GAAGTGAAATTCAATTGGTACGTGG ATGGGGTCGAAGTGCACAACGCCA AGACCAAGCCTAGGGAAGAACAGT ACgccTCTACGTACCGGGTGGTGTCC GTGCTGACCGTGCTGCACCAGGACT GGCTGAACGGAAAGGAGTACAAGT GCAAAGTGTCAAACAAGGCTCTCCC TGCCCCTATCGAAAAGACCATCAGC AAGGCCAAGGGTCAACCTAGGGAG CCCCAGGTCTACACTTTGCCGCCTA GCCGGGAAGAAATGACTAAGAACC AAGTGTCCCTGACTTGCCTTGTCAA GGGCTTTTATCCGTCCGACATCGCC GTGGAGTGGGAGTCCAACGGACAA CCGGAGAACAACTACAAGACCACC CCACCGGTGCTCGATTCCGATGGCT CCTTCTTCCTGTACTCCAAGCTGACT GTGGACAAGTCAAGATGGCAGCAG GGAAACGTGTTCTCCTGCTCCGTGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TGCACGAAGCGCTGCACAACCATTA<br>CACCCAGAAATCACTGTCACTTTCG<br>CCGGGAAAA |
| SEQ ID 2219 | QVQLQQSGPGLVKPSQTLSLTCAISGD SVSSKSAAWNWIRQSPSRGLEWLGRT YYRSKWNNDYALSVKSRITINPDTSKN QFSLQLKSVTPEDTALYYCVRQVAGG MDVWGQGTTVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2327 | CAGGTACAGCTGCAGCAGTCAGGTC CAGGGACTGGTGAAGCCCTCGCAGAC CCTCTCACTCACCTGTGCCATCTCCG GGGACAGTGTCTCTAGCAAAAGTGC TGCTTGGAACTGGATCAGGCAGTCC CCATCGAGAGGCCTTGAGTGGCTGG GAAGGACATACTACAGGTCCAAATG GAATAATGATTATGCATTATCTGTG AAAAGTCGAATAACCATCAACCCAG ACACATCCAAGAACCAGTTCTCCCT GCAGCTGAAGTCTGTGACTCCCGAG GACACGGCTCTGTATTACTGTGTAA GACAAGTCGCGGGCGGTATGGACGT CTGGGGCCAAGGGACCACGGTCACC GTCTCCTCAGCATCCACCAAGGGGC CTTCCGTGTTCCCCCTGGCCCCTTCA TCCAAGTCGACCTCTGGTGGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG GGTCGAAGTGCACAACGCCAAGAC CAAGCCTAGGGAAGAACAGTACgcc TCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2220 | QVQLVQSGGGLVQPGRSLRLSCTASGF TFGDYAMSWFRQAPGKGLEWVSAISG SGGSTYYADSVKGRFTISRDNSKNTLY LQMNSLRAEDTAVYYCAKGSVYSGSY YMLIDYWGQGTLVTVSSASTKGPSVFP LAPSSKSTSGGTAALGCLVKDYFPEPV TVSWNSGALTSGVHTFPAVLQSSGLYS LSSVVTVPSSSLGTQTYICNVNHKPSNT KVDKKVEPKSCDKTHTCPPCPAPELLG GPSVFLFPPKPKDTLMISRTPEVTCVVV DVSHEDPEVKFNWYVDGVEVHNAKT KPREEQYASTYRVVSVLTVLHQDWLN GKEYKCKVSNKALPAPIEKTISKAKGQ PREPQVYTLPPSREEMTKNQVSLTCLV | SEQ ID 2328 | CAGGTGCAGCTGGTGCAATCTGGGG GAGGCTTGGTACAGCCAGGGCGGTC CCTGAGACTCTCCTGTACAGCTTCT GGATTCACCTTTGGTGATTATGCTAT GAGCTGGTTCCGCCAGGCTCCAGGG AAGGGGCTGGAGTGGGTCTCAGCTA TTAGTGGTAGTGGTGGTAGCACATA CTATGCAGACTCCGTGAAGGGCCGA TTCACCATCTCCAGAGACAATTCCA AGAACACGCTGTATCTGCAAATGAA CAGCCTGAGAGCTGAGGACACGGCT GTGTATTACTGTGCGAAAGGATCGG TATATAGTGGGAGCTACTATATGCT CATTGACTACTGGGGCCAGGGCACC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | KGFYPSDIAVEWESNGQPENNYKTTPP VLDSDGSFFLYSKLTVDKSRWQQGNV FSCSVMHEALHNHYTQKSLSLSPGK | | CTGGTCACCGTCTCCTCAGCATCCA CCAAGGGGCCTTCCGTGTTCCCCCT GGCCCCTTCATCCAAGTCGACCTCT GGTGGAACCGCCGCACTCGGTTGCC TGGTCAAAGACTACTTCCCCGAGCC CGTGACTGTCTCGTGGAACTCGGGC GCCCTCACATCCGGAGTGCATACCT TTCCCGCCGTGTTGCAGTCCAGCGG CCTGTACAGCCTGAGCTCCGTCGTG ACAGTGCCGTCCTCCTCCCTTGGAA CCCAGACCTATATCTGCAACGTCAA TCACAAGCCCTCCAACACCAAAGTG GACAAGAAGGTCGAACCCAAGTCCT GCGACAAGACTCACACCTGTCCGCC TTGTCCAGCCCCTGAGCTGCTGGGT GGTCCGTCCGTGTTCCTCTTCCCGCC CAAGCCGAAGGACACTCTGATGATT TCACGCACCCCGGAAGTCACTTGCG TGGTCGTGGACGTGTCGCACGAAGA TCCCGAAGTGAAATTCAATTGGTAC GTGGATGGGGTCGAAGTGCACAAC GCCAAGACCAAGCCTAGGGAAGAA CAGTACGccTCTACGTACCGGGTGGT GTCCGTGCTGACCGTGCTGCACCAG GACTGGCTGAACGGAAAGGAGTAC AAGTGCAAAGTGTCAAACAAGGCTC TCCCTGCCCCTATCGAAAAGACCAT CAGCAAGGCCAAGGGTCAACCTAG GGAGCCCCAGGTCTACACTTTGCCG CCTAGCCGGGAAGAAATGACTAAG AACCAAGTGTCCCTGACTTGCCTTG TCAAGGGCTTTTATCCGTCCGACAT CGCCGTGGAGTGGGAGTCCAACGG ACAACCGGAGAACAACTACAAGAC CACCCCACCGGTGCTCGATTCCGAT GGCTCCTTCTTCCTGTACTCCAAGCT GACTGTGGACAAGTCAAGATGGCA GCAGGGAAACGTGTTCTCCTGCTCC GTGATGCACGAAGCGCTGCACAACC ATTACACCCAGAAATCACTGTCACT TTCGCCGGGAAAA |
| SEQ ID 2221 | QVQLQQSGPGLVRPSQTLSLTCVISGD SVSSGSAAWNWIRQSPSRGLEWLGRT YYRAKWYNEYAGSVKSRITISPDTSKN QFSLQLNSVTPEDTAVYFCTRQDKDNT RYSGLGVWGQGTTVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2329 | CAGGTACAGCTGCAGCAGTCAGGTC CAGGACTGGTGAGGCCCTCGCAGAC CCTCTCACTCACCTGTGTCATCTCCG GGGACAGTGTCTCTAGCGGCAGTGC TGCTTGGAACTGGATCAGGCAGTCC CCATCGAGAGGCCTTGAGTGGCTGG GAAGGACATATTATAGGGCCAAGTG GTATAATGAATATGCAGGGTCTGTG AAAAGCCGAATAACCATCAGTCCGG ACACATCCAAGAACCAGTTCTCCCT GCAACTGAACTCTGTGACTCCCGAG GACACGGCTGTGTATTTCTGTACAA GACAAGACAAAGACAACACGAGAT ATTCCGGTTTGGGCGTCTGGGGCCA AGGGACCACGGTGACCGTCTCCTCA GCATCCACCAAGGGGCCTTCCGTGT TCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCCGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2222 | EVQLVETGGGLVQPGGSLRLSCAASEF TLRNYGVSWVRQAPGKGLEWVSGMS GSGYSTYYADSVKGRFTISRDSSKNTL FLQMDSLRAEDTAIYYCARGPRMWSS GIDAFDIWGHGTMVTVSSASTKGPSVF PLAPSSKSTSGGTAALGCLVKDYFPEP VTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2330 | GAGGTGCAGCTGGTGGAGACCGGG GGAGGCTTAGTTCAGCCTGGGGGGT CCCTGAGACTCTCCTGTGCAGCCTC TGAATTCACCCTTAGGAACTATGGC GTGAGCTGGGTCCGCCAGGCTCCAG GGAAGGGGCTGGAGTGGGTCTCAG GTATGAGTGGTAGTGGTTATAGTAC ATACTACGCAGACTCCGTGAAGGGC CGGTTCACCATCTCCAGAGACAGTT CCAAGAACACGCTGTTTCTGCAAAT GGACAGCCTGAGAGCCGAGGACAC GGCCATATATTACTGTGCGGAGAGG CCCCGAATGTGGAGCAGTGGCATTG ATGCTTTTGATATCTGGGGCCACGG GACAATGGTGACCGTCTCTTCAGCA TCCACCAAGGGGCCTTCCGTGTTCC CCCTGGCCCCTTCATCCAAGTCGAC CTCTGGTGGAACCGCCGCACTCGGT TGCCTGGTCAAAGACTACTTCCCCG AGCCCGTGACTGTCTCGTGGAACTC GGGCGCCCTCACATCCGGAGTGCAT ACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CCGTGATGCACGAAGCGCTGCACAA |
| | | | CCATTACACCCAGAAATCACTGTCA |
| | | | CTTTCGCCGGGAAAA |
| SEQ ID 2223 | QVQLQQWGAGLLKPSETLSLTCAVYG GSVSGYYWSWIRQPPGKGLEWMGEIH HSGSTNYNPSLKSRVTISLDTPKNQFSL KLSSVTAADTAVYYCARRDWAGKRV WGQGTLVTVSSASTKGPSVFPLAPSSK STSGGTAALGCLVKDYFPEPVTVSWN SGALTSGVHTFPAVLQSSGLYSLSSVV TVPSSSLGTQTYICNVNHKPSNTKVDK KVEPKSCDKTHTCPPCPAPELLGGPSV FLFPPKPKDTLMISRTPEVTCVVVDVS HEDPEVKFNWYVDGVEVHNAKTKPR EEQYASTYRVVSVLTVLHQDWLNGKE YKCKVSNKALPAPIEKTISKAKGQPRE PQVYTLPPSREEMTKNQVSLTCLVKGF YPSDIAVEWESNGQPENNYKTTPPVLD SDGSFFLYSKLTVDKSRWQQGNVFSCS VMHEALHNHYTQKSLSLSPGK | SEQ ID 2331 | CAGGTGCAGCTACAGCAGTGGGGC GCAGGACTGTTGAAGCCTTCGGAGA CCCTGTCCCTCACCTGCGCTGTCTAT GGTGGGTCCGTCAGTGGTTACTACT GGAGCTGGATCCGCCAGCCCCCAGG GAAGGGGCTGGAGTGGATGGGGGA AATCCATCATAGTGGAAGCACCAAC TACAACCCGTCCCTCAAGAGTCGAG TCACCATATCACTAGACACGCCCAA GAACCAGTTCTCCCTGAAGCTAAGC TCTGTGACCGCCGCGGACACGGCTG TATATTACTGTGCGAGACGGGATTG GGCAGGAAAAGGGTCTGGGGCCA GGGAACCCTGGTCACCGTCTCCTCA GCATCCACCAAGGGGCCTTCCGTGT TCCCCCTGGCCCCTTCATCCAAGTC GACCTCTGGTGGAACCGCCGCACTC GGTTGCCTGGTCAAAGACTACTTCC CCGAGCCCGTGACTGTCTCGTGGAA CTCGGGCGCCCTCACATCCGGAGTG CATACCTTTCCGGCCGTGTTGCAGTC CAGCGGCCTGTACAGCCTGAGCTCC GTCGTGACAGTGCCGTCCTCCTCCC TTGGAACCCAGACCTATATCTGCAA CGTCAATCACAAGCCCTCCAACACC AAAGTGGACAAGAAGGTCGAACCC AAGTCCTGCGACAAGACTCACACCT GTCCGCCTTGTCCAGCCCCTGAGCT GCTGGGTGGTCCGTCCGTGTTCCTCT TCCCGCCCAAGCCGAAGGACACTCT GATGATTTCACGCACCCCGGAAGTC ACTTGCGTGGTCGTGGACGTGTCGC ACGAAGATCCCGAAGTGAAATTCAA TTGGTACGTGGATGGGGTCGAAGTG CACAACGCCAAGACCAAGCCTAGG GAAGAACAGTACgccTCTACGTACCG GGTGGTGTCCGTGCTGACCGTGCTG CACCAGGACTGGCTGAACGGAAAG GAGTACAAGTGCAAAGTGTCAAAC AAGGCTCTCCCTGCCCCTATCGAAA AGACCATCAGCAAGGCCAAGGGTC AACCTAGGGAGCCCCAGGTCTACAC TTTGCCGCCTAGCCGGGAAGAAATG ACTAAGAACCAAGTGTCCCTGACTT GCCTTGTCAAGGGCTTTTATCCGTCC GACATCGCCGTGGAGTGGGAGTCCA ACGGACAACCGGAGAACAACTACA AGACCACCCCACCGGTGCTCGATTC CGATGGCTCCTTCTTCCTGTACTCCA AGCTGACTGTGGACAAGTCAAGATG GCAGCAGGGAAACGTGTTCTCCTGC TCCGTGATGCACGAAGCGCTGCACA ACCATTACACCCAGAAATCACTGTC ACTTTCGCCGGGAAAA |
| SEQ ID 2224 | QVQLQQSGPGLLKPSQTLSLTCAISGD SVSSNTATWNWIRQSPSRGLEWLGRT YYRSKWYKDNALSVKSRITINPDTSKN QFSLQLNSVTPEDTAVYYCAGGRAGIA AFDIWGQGTTVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP | SEQ ID 2332 | CAGGTACAGCTGCAGCAGTCAGGTC CAGGACTATTAAAGCCCTCGCAGAC CCTCTCACTCACCTGTGCCATCTCCG GGGACAGTGTCTCTAGCAACACTGC TACTTGGAACTGGATCAGGCAGTCC CCATCGAGAGGCCTTGAGTGGCTGG GAAGGACATACTACAGGTCCAAGTG GTATAAGGATAATGCACTGTCTGTG AAAAGTCGAATAACCATCAACCCAG ACACATCCAAGAACCAGTTCTCCCT GCAGCTGAACTCTGTGACTCCCGAG GACACGGCTGTGTATTACTGTGCAG GAGGTCGGGCTGGTATTGCCGCTTT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | | TGATATCTGGGGCCAAGGGACCACG GTCACCGTCTCCTCAGCATCCACCA AGGGGCCTTCCGTGTTCCCCCTGGC CCCTTCATCCAAGTCGACCTCTGGT GGAACCGCCGCACTCGGTTGCCTGG TCAAAGACTACTTCCCCGAGCCCGT GACTGTCTCGTGGAACTCGGGCGCC CTCACATCCGGAGTGCATACCTTTC CCGCCGTGTTGCAGTCCAGCGGCCT GTACAGCCTGAGCTCCGTCGTGACA GTGCCGTCCTCCTCCCTTGGAACCC AGACCTATATCTGCAACGTCAATCA CAAGCCCTCCAACACCAAAGTGGAC AAGAAGGTCGAACCCAAGTCCTGCG ACAAGACTCACACCTGTCCGCCTTG TCCAGCCCCTGAGCTGCTGGGTGGT CCGTCCGTGTTCCTCTTCCCGCCCAA GCCGAAGGACACTCTGATGATTTCA CGCACCCCGGAAGTCACTTGCGTGG TCGTGGACGTGTCGCACGAAGATCC CGAAGTGAAATTCAATTGGTACGTG GATGGGGTCGAAGTGCACAACGCC AAGACCAAGCCTAGGGAAGAACAG TACgccTCTACGTACCGGGTGGTGTC CGTGCTGACCGTGCTGCACCAGGAC TGGCTGAACGGAAAGGAGTACAAG TGCAAAGTGTCAAACAAGGCTCTCC CTGCCCCTATCGAAAAGACCATCAG CAAGGCCAAGGGTCAACCTAGGGA GCCCCAGGTCTACACTTTGCCGCCT AGCCGGGAAGAAATGACTAAGAAC CAAGTGTCCCTGACTTGCCTTGTCA AGGGCTTTTATCCGTCCGACATCGC CGTGGAGTGGGAGTCCAACGGACA ACCGGAGAACAACTACAAGACCAC CCCACCGGTGCTCGATTCCGATGGC TCCTTCTTCCTGTACTCCAAGCTGAC TGTGGACAAGTCAAGATGGCAGCA GGGAAACGTGTTCTCCTGCTCCGTG ATGCACGAAGCGCTGCACAACCATT ACACCCAGAAATCACTGTCACTTTC GCCGGGAAAA |
| SEQ ID 2225 | QVQLVQSGGGLIQPGGSLRLSCAASGF TVSSNYMSWVRQAPGKGLEWVSLIYS DGRTNYADSVKGRFTISRDNSKNTLYL QMNSLRAEDTAVYYCAKGALQGEWR RFDYWGQGTLVTVSSASTKGPSVFPLA PSSKSTSGGTAALGCLVKDYFPEPVTV SWNSGALTSGVHTFPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2333 | CAGGTGCAGCTGGTGCAATCTGGAG GAGGCTTGATCCAGCCTGGGGGGTC CCTGAGACTCTCCTGTGCAGCCTCT GGGTTCACCGTCAGTAGCAACTACA TGAGCTGGGTCCGCCAGGCTCCAGG GAAGGGGCTGGAATGGGTCTCACTT ATTTATAGTGATGGTCGCACAAACT ATGCAGACTCCGTGAAGGGCCGATT CACCATCTCCAGAGACAATTCCAAG AACACGCTGTATCTGCAAATGAACA GCCTGAGAGCCGAGGACACGGCCG TATATTACTGTGCGAAGGGGGCCCT ACAGGGCGAATGGCGGAGATTTGA CTACTGGGGCCAGGGCACCCTGGTC ACCGTCTCCTCAGCATCCACCAAGG GCCCTTCCGTGTTCCCCCTGGCCCCT TCATCCAAGTCGACCTCTGGTGGAA CCGCCGCACTCGGTTGCCTGGTCAA AGACTACTTCCCCGAGCCCGTGACT GTCTCGTGGAACTCGGGCGCCCTCA CATCCGGAGTGCATACCTTTCCCGC CGTGTTGCAGTCCAGCGGCCTGTAC AGCCTGAGCTCCGTCGTGACAGTGC CGTCCTCCTCCCTTGGAACCCAGAC CTATATCTGCAACGTCAATCACAAG CCCTCCAACACCAAAGTGGACAAGA AGGTCGAACCCAAGTCCTGCGACAA GACTCACACCTGTCCGCCTTGTCCA GCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AGTGAAATTCAATTGGTACGTGGAT
GGGGTCGAAGTGCACAACGCCAAG
ACCAAGCCTAGGGAAGAACAGTACg
ccTCTACGTACCGGGTGGTGTCCGTG
CTGACCGTGCTGCACCAGGACTGGC
TGAACGGAAAGGAGTACAAGTGCA
AAGTGTCAAACAAGGCTCTCCCTGC
CCCTATCGAAAAGACCATCAGCAAG
GCCAAGGGTCAACCTAGGGAGCCCC
AGGTCTACACTTTGCCGCCTAGCCG
GGAAGAAATGACTAAGAACCAAGT
GTCCCTGACTTGCCTTGTCAAGGGC
TTTTATCCGTCCGACATCGCCGTGG
AGTGGGAGTCCAACGGACAACCGG
AGAACAACTACAAGACCACCCCACC
GGTGCTCGATTCCGATGGCTCCTTCT
TCCTGTACTCCAAGCTGACTGTGGA
CAAGTCAAGATGGCAGCAGGGAAA
CGTGTTCTCCTGCTCCGTGATGCAC
GAAGCGCTGCACAACCATTACACCC
AGAAATCACTGTCACTTTCGCCGGG
AAAA |
| SEQ ID 2226 | QVQLQQSGPGLVKPSQTLSLTCAISGD
SVSSNSAAWNWIRQSPSRGLEWLGRT
YYRSKWYNDYAVSVKSRITINPDTSKN
QFSLQLNSVTPEDTAVYYCTRTNQGY
GGNSGVFDYWGQGTLVTVSSASTKGP
SVFPLAPSSKSTSGGTAALGCLVKDYF
PEPVTVSWNSGALTSGVHTFPAVLQSS
GLYSLSSVVTVPSSSLGTQTYICNVNH
KPSNTKVDKKVEPKSCDKTHTCPPCPA
PELLGGPSVFLFPPKPKDTLMISRTPEV
TCVVVDVSHEDPEVKFNWYVDGVEV
HNAKTKPREEQYASTYRVVSVLTVLH
QDWLNGKEYKCKVSNKALPAPIEKTIS
KAKGQPREPQVYTLPPSREEMTKNQV
SLTCLVKGFYPSDIAVEWESNGQPENN
YKTTPPVLDSDGSFFLYSKLTVDKSRW
QQGNVFSCSVMHEALHNHYTQKSLSL
SPGK | SEQ ID 2334 | CAGGTGCAGCTACAGCAGTCAGGTC
CAGGACTGGTGAAGCCCTCGCAGAC
CCTCTCACTCACCTGTGCCATCTCCG
GGGACAGTGTCTAGCAACAGTGC
TGCTTGGAACTGGATCAGGCAGTCC
CCATCGAGAGGCCTTGAGTGGCTGG
GAAGGACATATTACAGGTCCAAGTG
GTATAATGATTATGCAGTATCTGTG
AAAAGTCGAATAACCATCAACCCAG
ACACATCCAAGAACCAGTTCTCCCT
GCAGCTGAACTCTGTGACTCCCGAG
GACACGGCTGTGTATTACTGTACAA
GAACCAACCAGGGATACGGTGGTA
ACTCCGGGGTATTTGACTACTGGGG
CCAGGGAACCCTGGTCACCGTCTCC
TCAGCATCCACCAAGGGGCCTTCCG
TGTTCCCCCTGGCCCCTTCATCCAAG
TCGACCTCTGGTGGAACCGCCGCAC
TCGGTTGCCTGGTCAAAGACTACTT
CCCCGAGCCCGTGACTGTCTCGTGG
AACTCGGGCGCCCTCACATCCGGAG
TGCATACCTTTCCCGCCGTGTTGCA
GTCCAGCGGCCTGTACAGCCTGAGC
TCCGTCGTGACAGTGCCGTCCTCCT
CCCTTGGAACCCAGACCTATATCTG
CAACGTCAATCACAAGCCCTCCAAC
ACCAAAGTGGACAAGAAGGTCGAA
CCCAAGTCCTGCGACAAGACTCACA
CCTGTCCGCCTTGTCCAGCCCCTGA
GCTGCTGGGTGGTCCGTCCGTGTTC
CTCTTCCCGCCCAAGCCGAAGGACA
CTCTGATGATTTCACGCACCCCGGA
AGTCACTTGCGTGGTCGTGGACGTG
TCGCACGAAGATCCCGAAGTGAAAT
TCAATTGGTACGTGGATGGGGTCGA
AGTGCACAACGCCAAGACCAAGCCT
AGGGAAGAACAGTACgccTCTACGTA
CCGGGTGGTGTCCGTGCTGACCGTG
CTGCACCAGGACTGGCTGAACGGAA
AGGAGTACAAGTGCAAAGTGTCAA
ACAAGGCTCTCCCTGCCCCTATCGA
AAAGACCATCAGCAAGGCCAAGGG
TCAACCTAGGGAGCCCCAGGTCTAC
ACTTTGCCGCCTAGCCGGGAAGAAA
TGACTAAGAACCAAGTGTCCCTGAC
TTGCCTTGTCAAGGGCTTTTATCCGT
CCGACATCGCCGTGGAGTGGGAGTC
CAACGGACAACCGGAGAACAACTA
CAAGACCACCCCACCGGTGCTCGAT
TCCGATGGCTCCTTCTTCCTGTACTC
CAAGCTGACTGTGGACAAGTCAAGA
TGGCAGCAGGGAAACGTGTTCTCCT |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GCTCCGTGATGCACGAAGCGCTGCA CAACCATTACACCCAGAAATCACTG TCACTTTCGCCGGGAAAA |
| SEQ ID 2227 | QVQLQQSGPGLVKPSQTLSLTCAISGD SVSGNSAAWNWIRQSPSRGLEWLGRT YYRSKWYNDYAVSVKSRITINPDTSKN QFSLQLNSVTPEDTAVYYCARIVGGAV DCWGQGTLVTVSSASTKGPSVFPLAPS SKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2335 | CAGGTGCAGCTACAGCAGTCAGGTC CAGGGACTGGTGAAGCCCTCGCAGAC CCTCTCACTCACCTGTGCCATCTCCG GGGACAGTGTCTCTGGCAACAGTGC TGCTTGGAACTGGATCAGGCAGTCC CCATCGAGAGGCCTTGAGTGGCTGG GAAGGACATACTACAGGTCCAAGTG GTATAATGATTATGCAGTATCTGTG AAAAGTCGAATAACCATCAACCCAG ACACATCCAAGAACCAGTTCTCCCT GCAGTTGAATTCTGTGACTCCCGAG GACACGGCTGTGTATTACTGTGCGA GGATAGTGGGAGGTGCCGTTGACTG CTGGGGCCAGGGAACCCTGGTGACC GTCTCCTCAGCATCCACCAAGGGGC CTTCCGTGTTCCCCCTGGCCCCTTCA TCCAAGTCGACCTCTGGTGGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG GGTCGAAGTGCACAACGCCAAGAC CAAGCCTAGGGAAGAACAGTACgcc TCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2228 | EVQLVQSGAEVKKPGASVKVSCKASG YTFTSYAMHWVRQAPGQRLEWMGWI NAGNGNTKYSQKFQGRVTITRDTSAST AYMELSSLRSEDTAVYYCARVRVGAT TVYDSWFDPWGQGTLVTVSSASTKGP SVFPLAPSSKSTSGGTAALGCLVKDYF PEPVTVSWNSGALTSGVHTFPAVLQSS GLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV | SEQ ID 2336 | GAGGTGCAGCTGGTGCAGTCTGGGG CTGAGGTGAAGAAGCCTGGGGCCTC AGTGAAGGTTTCCTGCAAGGCTTCT GGATACACCTTCACTAGCTATGCTA TGCATTGGGTGCGCCAGGCCCCCGG ACAAAGGCTTGAGTGGATGGGATG GATCAACGCTGGCAATGGTAACACA AAATATTCACAGAAGTTCCAGGGCA GAGTCACCATTACCAGGGACACATC CGCGAGCACAGCCTACATGGAGCTG AGCAGCCTGAGATCTGAAGACACG GCTGTGTATTACTGTGCGAGAGTTA GAGTGGGAGCTACTACTGTTTACGA CAGCTGGTTCGACCCCTGGGGCCAG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | SLTCLVKGFYPSDIAVEWESNGQPENN YKTTPPVLDSDGSFFLYSKLTVDKSRW QQGNVFSCSVMHEALHNHYTQKSLSL SPGK | | GGAACCCTGGTGACCGTCTCCTCAG CATCCACCAAGGGGCCTTCCGTGTT CCCCCTGGCCCCTTCATCCAAGTCG ACCTCTGGTGGAACCGCCGCACTCG GTTGCCTGGTCAAAGACTACTTCCC CGAGCCCGTGACTGTCTCGTGGAAC TCGGGCGCCCTCACATCCGGAGTGC ATACCTTTCCCGCCGTGTTGCAGTCC AGCGGCCTGTACAGCCTGAGCTCCG TCGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2229 | QVQLVQSGGGLVQPGGSLRLSCAASG FTFSSYAMSWVRQAPGKGLEWVSAIS GSGGSTYYADSVKGRFTISRDNSKNTL YLQMNSLRAEDTAVYYCAKDGGSSPY YDSSGLLPWYFDLWGRGTLVTVSSAS TKGPSVFPLAPSSKSTSGGTAALGCLV KDYFPEPVTVSWNSGALTSGVHTFPA VLQSSGLYSLSSVVTVPSSSLGTQTYIC NVNHKPSNTKVDKKVEPKSCDKTHTC PPCPAPELLGGPSVFLFPPKPKDTLMIS RTPEVTCVVVDVSHEDPEVKFNWYVD GVEVHNAKTKPREEQYASTYRVVSVL TVLHQDWLNGKEYKCKVSNKALPAPI EKTISKAKGQPREPQVYTLPPSREEMT KNQVSLTCLVKGFYPSDIAVEWESNG QPENNYKTTPPVLDSDGSFFLYSKLTV DKSRWQQGNVFSCSVMHEALHNHYT QKSLSLSPGK | SEQ ID 2337 | CAGGTGCAGCTGGTGCAGTCTGGGG GAGGCTTGGTACAGCCTGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAGTGGGTCTCAGCT ATTAGTGGTAGTGGTGGTAGCACAT ACTACGCAGACTCCGTGAAGGGCCG GTTCACCATCTCCAGAGACAATTCC AAGAACACGCTGTATCTGCAAATGA ACAGCCTGAGAGCCGAGGACACGG CCGTATATTACTGTGCGAAAGATGG GGGGTCCAGCCCATACTATGATAGT AGTGGTTTACTACCCTGGTACTTCG ATCTCTGGGGCCGTGGCACCCTGGT CACCGTCTCCTCAGCATCCACCAAG GGGCCTTCCGTGTTCCCCCTGGCCC CTTCATCCAAGTCGACCTCTGGTGG AACCGCCGCACTCGGTTGCCTGGTC AAAGACTACTTCCCCGAGCCCGTGA CTGTCTCGTGGAACTCGGGCGCCCT CACATCCGGAGTGCATACCTTTCCC GCCGTGTTGCAGTCCAGCGGCCTGT ACAGCCTGAGCTCCGTCGTGACAGT GCCGTCCTCCTCCCTTGGAACCCAG ACCTATATCTGCAACGTCAATCACA AGCCCTCCAACACCAAAGTGGACAA GAAGGTCGAACCCAAGTCCTGCGAC AAGACTCACACCTGTCCGCCTTGTC CAGCCCCTGAGCTGCTGGGTGGTCC GTCCGTGTTCCTCTTCCCGCCCAAGC CGAAGGACACTCTGATGATTTCACG CACCCCGGAAGTCACTTGCGTGGTC GTGGACGTGTCGCACGAAGATCCCG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | AAGTGAAATTCAATTGGTACGTGGA TGGGGTCGAAGTGCACAACGCCAA GACCAAGCCTAGGGAAGAACAGTA CgccTCTACGTACCGGGTGGTGTCCG TGCTGACCGTGCTGCACCAGGACTG GCTGAACGGAAAGGAGTACAAGTG CAAAGTGTCAAACAAGGCTCTCCCT GCCCCTATCGAAAAGACCATCAGCA AGGCCAAGGGTCAACCTAGGGAGC CCCAGGTCTACACTTTGCCGCCTAG CCGGGAAGAAATGACTAAGAACCA AGTGTCCCTGACTTGCCTTGTCAAG GGCTTTTATCCGTCCGACATCGCCG TGGAGTGGGAGTCCAACGGACAAC CGGAGAACAACTACAAGACCACCC CACCGGTGCTCGATTCCGATGGCTC CTTCTTCCTGTACTCCAAGCTGACTG TGGACAAGTCAAGATGGCAGCAGG GAAACGTGTTCTCCTGCTCCGTGAT GCACGAAGCGCTGCACAACCATTAC ACCCAGAAATCACTGTCACTTTCGC CGGGAAAA |
| SEQ ID 2230 | QVQLQESGGGLVQPGGSLRLSCAASG FTFSSYAMHWVRQAPGKGLEYVSAISS NGGSTYYANSVKGRFTISRDNSKNTLY LQMGSLRAEDMAVYYCARAKFWTYY FDYWGQGTLVTVSSASTKGPSVFPLAP SSKSTSGGTAALGCLVKDYFPEPVTVS WNSGALTSGVHTFPAVLQSSGLYSLSS VVTVPSSSLGTQTYICNVNHKPSNTKV DKKVEPKSCDKTHTCPPCPAPELLGGP SVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2338 | CAGGTGCAGCTGCAGGAGTCGGGG GGAGGCTTGGTCCAGCCTGGGGGGT CCCTGAGACTCTCCTGTGCAGCCTC TGGATTCACCTTCAGTAGCTATGCT ATGCACTGGGTCCGCCAGGCTCCAG GGAAGGGACTGGAATATGTTTCAGC TATTAGTAGTAATGGGGGTAGCACA TATTATGCAAACTCTGTGAAGGGCA GATTCACCATCTCCAGAGACAATTC CAAGAACACGCTGTATCTTCAAATG GGCAGCCTGAGAGCTGAGGACATG GCTGTGTATTACTGTGCGAGAGCTA AGTTTTGGACATACTACTTTGACTA CTGGGGCCAGGGAACCCTGGTGACC GTCTCCTCAGCATCCACCAAGGGGC CTTCCGTGTTCCCCCTGGCCCCTTCA TCCAAGTCGACCTCTGGTGGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG GGTCGAAGTGCACAACGCCAAGAC CAAGCCTAGGGAAGAACAGTACgcc TCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | TGTTCTCCTGCTCCGTGATGCACGA<br>AGCGCTGCACAACCATTACACCCAG<br>AAATCACTGTCACTTTCGCCGGGAA<br>AA |
| SEQ ID<br>2231 | QVQLQQWGAGLLKPSETLSLTCAVYG<br>GSFSGYYWSWIRQPPGKGLEWIGEINH<br>SGSTNYNPSLKSRVTISVDTSKNQFSLK<br>LSSVTAADTAVYYCARGGGSGSYYKR<br>FFDYWGQGTLVTVSSASTKGPSVFPLA<br>PSSKSTSGGTAALGCLVKDYFPEPVTV<br>SWNSGALTSGVHTFPAVLQSSGLYSLS<br>SVVTVPSSSLGTQTYICNVNHKPSNTK<br>VDKKVEPKSCDKTHTCPPCPAPELLGG<br>PSVFLFPPKPKDTLMISRTPEVTCVVVD<br>VSHEDPEVKFNWYVDGVEVHNAKTK<br>PREEQYASTYRVVSVLTVLHQDWLNG<br>KEYKCKVSNKALPAPIEKTISKAKGQP<br>REPQVYTLPPSREEMTKNQVSLTCLVK<br>GFYPSDIAVEWESNGQPENNYKTTPPV<br>LDSDGSFFLYSKLTVDKSRWQQGNVF<br>SCSVMHEALHNHYTQKSLSLSPGK | SEQ ID<br>2339 | CAGGTGCAGCTACAGCAGTGGGGC<br>GCAGGACTGTTGAAGCCTTCGGAGA<br>CCCTGTCCCTCACCTGCGCTGTCTAT<br>GGTGGGTCCTTCAGTGGTTACTACT<br>GGAGCTGGATCCGCCAGCCCCCAGG<br>GAAGGGGCTGGAGTGGATTGGGGA<br>AATCAATCATAGTGGAAGCACCAAC<br>TACAACCCGTCCCTCAAGAGTCGAG<br>TCACCATATCAGTAGACACGTCCAA<br>GAACCAGTTCTCCCTGAAGCTGAGC<br>TCTGTGACCGCCGCGGACACGGCTG<br>TGTATTACTGTGCGAGAGGCGGTGG<br>TTCGGGGAGTTATTATAAGAGGTTC<br>TTTGACTACTGGGGCCAGGGAACCC<br>TGGTCACCGTCTCCTCAGCATCCAC<br>CAAGGGGCCTTCCGTGTTCCCCCTG<br>GCCCCTTCATCCAAGTCGACCTCTG<br>GTGGAACCGCCGCACTCGGTTGCCT<br>GGTCAAAGACTACTTCCCCGAGCCC<br>GTGACTGTCTCGTGGAACTCGGGCG<br>CCCTCACATCCGGAGTGCATACCTT<br>TCCCGCCGTGTTGCAGTCCAGCGGC<br>CTGTACAGCCTGAGCTCCGTCGTGA<br>CAGTGCCGTCCTCCCTTGGAAC<br>CCAGACCTATATCTGCAACGTCAAT<br>CACAAGCCCTCCAACACCAAAGTGG<br>ACAAGAAGGTCGAACCCAAGTCCTG<br>CGACAAGACTCACACCTGTCCGCCT<br>TGTCCAGCCCTGAGCTGCTGGGTG<br>GTCCGTCCGTGTTCCTCTTCCCGCCC<br>AAGCCGAAGGACACTCTGATGATTT<br>CACGCACCCCGGAAGTCACTTGCGT<br>GGTCGTGGACGTGTCGCACGAAGAT<br>CCCGAAGTGAAATTCAATTGGTACG<br>TGGATGGGGTCGAAGTGCACAACGC<br>CAAGACCAAGCCTAGGGAAGAACA<br>GTACgccTCTACGTACCGGGTGGTGT<br>CCGTGCTGACCGTGCTGCACCAGGA<br>CTGGCTGAACGGAAAGGAGTACAA<br>GTGCAAAGTGTCAAACAAGGCTCTC<br>CCTGCCCCTATCGAAAAGACCATCA<br>GCAAGGCCAAGGGTCAACCTAGGG<br>AGCCCCAGGTCTACACTTTGCCGCC<br>TAGCCGGGAAGAAATGACTAAGAA<br>CCAAGTGTCCCTGACTTGCCTTGTC<br>AAGGGCTTTTATCCGTCCGACATCG<br>CCGTGGAGTGGGAGTCCAACGGAC<br>AACCGGAGAACAACTACAAGACCA<br>CCCCACCGGTGCTCGATTCCGATGG<br>CTCCTTCTTCCTGTACTCCAAGCTGA<br>CTGTGGACAAGTCAAGATGGCAGCA<br>GGGAAACGTGTTCTCCTGCTCCGTG<br>ATGCACGAAGCGCTGCACAACCATT<br>ACACCCAGAAATCACTGTCACTTTC<br>GCCGGGAAAA |
| SEQ ID<br>2232 | EVQLVQSGAEVRKPGASVKVSCKASG<br>YTFTSYAISWVRQAPGQGLEWMGWIS<br>AYDGNTNYAQKLQGRVTMTTDTSTST<br>AYMEVRSLRSDDTAVYYCARDGTVR<br>RVVGATTPGNFDYRGQGTLVTVSSAS<br>TKGPSVFPLAPSSKSTSGGTAALGCLV<br>KDYFPEPVTVSWNSGALTSGVHTFPA<br>VLQSSGLYSLSSVVTVPSSSLGTQTYIC<br>NVNHKPSNTKVDKKVEPKSCDKTHTC<br>PPCPAPELLGGPSVFLFPPKPKDTLMIS<br>RTPEVTCVVVDVSHEDPEVKFNWYVD<br>GVEVHNAKTKPREEQYASTYRVVSVL<br>TVLHQDWLNGKEYKCKVSNKALPAPI<br>EKTISKAKGQPREPQVYTLPPSREEMT | SEQ ID<br>2340 | GAGGTGCAGCTGGTGCAGTCTGGAG<br>CTGAGGTGAGGAAGCCTGGGGCCTC<br>AGTGAAGGTCTCCTGCAAGGCTTCT<br>GGTTACACATTTACCAGTTATGCCA<br>TCAGCTGGGTGCGACAGGCCCCTGG<br>ACAAGGGCTTGAGTGGATGGGGTG<br>GATCAGCGCTTACGACGGTAACACA<br>AACTATGCACAGAAGCTCCAGGGCA<br>GAGTCACCATGACCACAGACACATC<br>CACGAGCACAGCCTACATGGAGGTG<br>AGGAGCCTGAGATCTGACGACACG<br>GCCGTGTATTACTGTGCGAGAGATG<br>GTACGGTCCGAAGGGTAGTGGGAG<br>CTACTACCCCTGGAAACTTTGACTA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | KNQVSLTCLVKGFYPSDIAVEWESNG QPENNYKTTPPVLDSDGSFFLYSKLTV DKSRWQQGNVFSCSVMHEALHNHYT QKSLSLSPGK | | CAGGGGCCAGGGAACCCTGGTCACC GTCTCCTCAGCATCCACCAAGGGGC CTTCCGTGTTCCCCCTGGCCCCTTCA TCCAAGTCGACCTCTGGTGGAACCG CCGCACTCGGTTGCCTGGTCAAAGA CTACTTCCCCGAGCCCGTGACTGTC TCGTGGAACTCGGGCGCCCTCACAT CCGGAGTGCATACCTTTCCCGCCGT GTTGCAGTCCAGCGGCCTGTACAGC CTGAGCTCCGTCGTGACAGTGCCGT CCTCCTCCCTTGGAACCCAGACCTA TATCTGCAACGTCAATCACAAGCCC TCCAACACCAAAGTGGACAAGAAG GTCGAACCCAAGTCCTGCGACAAGA CTCACACCTGTCCGCCTTGTCCAGC CCCTGAGCTGCTGGGTGGTCCGTCC GTGTTCCTCTTCCCGCCCAAGCCGA AGGACACTCTGATGATTTCACGCAC CCCGGAAGTCACTTGCGTGGTCGTG GACGTGTCGCACGAAGATCCCGAAG TGAAATTCAATTGGTACGTGGATGG GGTCGAAGTGCACAACGCCAAGAC CAAGCCTAGGGAAGAACAGTACgcc TCTACGTACCGGGTGGTGTCCGTGC TGACCGTGCTGCACCAGGACTGGCT GAACGGAAAGGAGTACAAGTGCAA AGTGTCAAACAAGGCTCTCCCTGCC CCTATCGAAAAGACCATCAGCAAGG CCAAGGGTCAACCTAGGGAGCCCCA GGTCTACACTTTGCCGCCTAGCCGG GAAGAAATGACTAAGAACCAAGTG TCCCTGACTTGCCTTGTCAAGGGCTT TTATCCGTCCGACATCGCCGTGGAG TGGGAGTCCAACGGACAACCGGAG AACAACTACAAGACCACCCCACCGG TGCTCGATTCCGATGGCTCCTTCTTC CTGTACTCCAAGCTGACTGTGGACA AGTCAAGATGGCAGCAGGGAAACG TGTTCTCCTGCTCCGTGATGCACGA AGCGCTGCACAACCATTACACCCAG AAATCACTGTCACTTTCGCCGGGAA AA |
| SEQ ID 2233 | EVQLVQSGGGVVQPGRSLRLSCAASG FTFSSYGMHWVRQAPGKGLEWVAVI WYDGSNKYYADSVKGRFTISRDNSKN TLYLQMNSLRAEDTAVYYCARDLNRG YCSGGSCFGYWGQGTLVTVSSASTKG PSVFPLAPSSKSTSGGTAALGCLVKDY FPEPVTVSWNSGALTSGVHTFPAVLQS SGLYSLSSVVTVPSSSLGTQTYICNVNH KPSNTKVDKKVEPKSCDKTHTCPPCPA PELLGGPSVFLFPPKPKDTLMISRTPEV TCVVVDVSHEDPEVKFNWYVDGVEV HNAKTKPREEQYASTYRVVSVLTVLH QDWLNGKEYKCKVSNKALPAPIEKTIS KAKGQPREPQVYTLPPSREEMTKNQV SLTCLVKGFYPSDIAVEWESNGQPENN YKTTPPVLDSDGSFFLYSKLTVDKSRW QQGNVFSCSVMHEALHNHYTQKSLSL SPGK | SEQ ID 2341 | GAGGTGCAGCTGGTGCAGTCTGGGG GAGGCGTGGTCCAGCCTGGGAGGTC CCTGAGACTCTCCTGTGCAGCGTCT GGATTCACCTTCAGTAGCTATGGCA TGCACTGGGTCCGCCAGGCTCCAGG CAAGGGGCTGGAGTGGGTGGCAGTT ATATGGTATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCCGAGGACACGG CTGTGTATTACTGTGCGAGAGATCT GAATCGAGGATATTGTAGTGGTGGT AGCTGCTTTGGCTACTGGGGCCAGG GAACCCTGGTCACCGTCTCCTCAGC ATCCACCAAGGGGCCTTCCGTGTTC CCCCTGGCCCCTTCATCCAAGTCGA CCTCTGGTGGAACCGCCGCACTCGG TTGCCTGGTCAAAGACTACTTCCCC GAGCCCGTGACTGTCTCGTGGAACT CGGGCGCCCTCACATCCGGAGTGCA TACCTTTCCCGCCGTGTTGCAGTCCA GCGGCCTGTACAGCCTGAGCTCCGT CGTGACAGTGCCGTCCTCCTCCCTT GGAACCCAGACCTATATCTGCAACG TCAATCACAAGCCCTCCAACACCAA AGTGGACAAGAAGGTCGAACCCAA GTCCTGCGACAAGACTCACACCTGT CCGCCTTGTCCAGCCCCTGAGCTGC TGGGTGGTCCGTCCGTGTTCCTCTTC CCGCCCAAGCCGAAGGACACTCTGA TGATTTCACGCACCCCGGAAGTCAC TTGCGTGGTCGTGGACGTGTCGCAC |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | GAAGATCCCGAAGTGAAATTCAATT GGTACGTGGATGGGGTCGAAGTGCA CAACGCCAAGACCAAGCCTAGGGA AGAACAGTACgccTCTACGTACCGGG TGGTGTCCGTGCTGACCGTGCTGCA CCAGGACTGGCTGAACGGAAAGGA GTACAAGTGCAAAGTGTCAAACAA GGCTCTCCCTGCCCCTATCGAAAAG ACCATCAGCAAGGCCAAGGGTCAA CCTAGGGAGCCCCAGGTCTACACTT TGCCGCCTAGCCGGGAAGAAATGAC TAAGAACCAAGTGTCCCTGACTTGC CTTGTCAAGGGCTTTTATCCGTCCG ACATCGCCGTGGAGTGGGAGTCCAA CGGACAACCGGAGAACAACTACAA GACCACCCCACCGGTGCTCGATTCC GATGGCTCCTTCTTCCTGTACTCCAA GCTGACTGTGGACAAGTCAAGATGG CAGCAGGGAAACGTGTTCTCCTGCT CCGTGATGCACGAAGCGCTGCACAA CCATTACACCCAGAAATCACTGTCA CTTTCGCCGGGAAAA |
| SEQ ID 2234 | QVQLQESGGGLVQPGGSLRLSCAASG FTFSSYAMSWVRQAPGKGLEWVSYIS SSGTTIYYADSVKGRFTVSRDNAKNSL YLQMNSLRAEDTAVYYCARDYSSSGE CFDYWGQGTLVTVSSASTKGPSVFPLA PSSKSTSGGTAALGCLVKDYFPEPVTV SWNSGALTSGVHTFPPAVLQSSGLYSLS SVVTVPSSSLGTQTYICNVNHKPSNTK VDKKVEPKSCDKTHTCPPCPAPELLGG PSVFLFPPKPKDTLMISRTPEVTCVVVD VSHEDPEVKFNWYVDGVEVHNAKTK PREEQYASTYRVVSVLTVLHQDWLNG KEYKCKVSNKALPAPIEKTISKAKGQP REPQVYTLPPSREEMTKNQVSLTCLVK GFYPSDIAVEWESNGQPENNYKTTPPV LDSDGSFFLYSKLTVDKSRWQQGNVF SCSVMHEALHNHYTQKSLSLSPGK | SEQ ID 2342 | CAGGTGCAGCTGCAGGAGTCTGGGG GAGGCTTGGTACAGCCGGGGGGGTC CCTGAGACTCTCCTGTGCAGCCTCT GGATTCACCTTTAGCAGCTATGCCA TGAGCTGGGTCCGCCAGGCTCCAGG GAAGGGGCTGGAGTGGGTTTCATAC ATTAGTAGTAGTGGTACTACCATAT ACTACGCAGACTCTGTGAAGGGCCG ATTCACCGTCTCCAGAGACAATGCC AAGAACTCACTGTATCTGCAAATGA ACAGCCTGAGAGCCGAGGACACGG CCGTGTATTACTGTGCGAGGGATTA TAGCAGCTCGGGGGAGTGCTTTGAC TACTGGGGCCAGGGAACCCTGGTCA CCGTCTCCTCAGCATCCACCAAGGG CCCTTCCGTGTTCCCCCTGGCCCCTT CATCCAAGTCGACCTCTGGTGGAAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCCGCC GTGTTGCAGTCCAGCGGCCTGTACA GCCTGAGCTCCGTCGTGACAGTGCC GTCCTCCTCCCTTGGAACCCAGACC TATATCTGCAACGTCAATCACAAGC CCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC CCCTATCGAAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | | | CGTGTTCTCCTGCTCCGTGATGCAC GAAGCGCTGCACAACCATTACACCC AGAAATCACTGTCACTTTCGCCGGG AAAA |
| SEQ ID 2235 | EVQLVQSGGGVVQPGRSLRLSCAASG FTFSSYGMHWVRQAPGKGLEWVAVI WYDGSNKYYADSVKGRFTISRDNSKN TLYLQMNSLRAEDTAVYYCARDQAA MVGYFDYWGQGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | SEQ ID 2343 | GAGGTGCAGCTGGTGCAGTCTGGGG GAGGCGTGGTCCAGCCTGGGAGGTC CCTGAGACTCTCCTGTGCAGCGTCT GGATTCACCTTCAGTAGCTATGGCA TGCACTGGGTCCGCCAGGCTCCAGG CAAGGGGCTGGAGTGGGTGGCAGTT ATATGGTATGATGGAAGTAATAAAT ACTATGCAGACTCCGTGAAGGGCCG ATTCACCATCTCCAGAGACAATTCC AAGAACACGCTGTATCTGCAAATGA ACAGCCTGAGAGCCGAGGACACGG CTGTGTATTACTGTGCGAGAGATCA GGCAGCTATGGTAGGCTACTTTGAC TACTGGGGCCAGGGAACCCTGGTCA CCGTCTCCTCAGCATCCACCAAGGG GCCTTCCGTGTTCCCCCTGGCCCCTT CATCCAAGTCGACCTCTGGTGGAAC CGCCGCACTCGGTTGCCTGGTCAAA GACTACTTCCCCGAGCCCGTGACTG TCTCGTGGAACTCGGGCGCCCTCAC ATCCGGAGTGCATACCTTTCCCGCC GTGTTGCAGTCCAGCGGCCTGTACA GCCTGAGCTCCGTCGTGACAGTGCC GTCCTCCTCCCTTGGAACCCAGACC TATATCTGCAACGTCAATCACAAGC CCTCCAACACCAAAGTGGACAAGA AGGTCGAACCCAAGTCCTGCGACAA GACTCACACCTGTCCGCCTTGTCCA GCCCCTGAGCTGCTGGGTGGTCCGT CCGTGTTCCTCTTCCCGCCCAAGCC GAAGGACACTCTGATGATTTCACGC ACCCCGGAAGTCACTTGCGTGGTCG TGGACGTGTCGCACGAAGATCCCGA AGTGAAATTCAATTGGTACGTGGAT GGGGTCGAAGTGCACAACGCCAAG ACCAAGCCTAGGGAAGAACAGTACg ccTCTACGTACCGGGTGGTGTCCGTG CTGACCGTGCTGCACCAGGACTGGC TGAACGGAAAGGAGTACAAGTGCA AAGTGTCAAACAAGGCTCTCCCTGC CCCTATCGAAAAGACCATCAGCAAG GCCAAGGGTCAACCTAGGGAGCCCC AGGTCTACACTTTGCCGCCTAGCCG GGAAGAAATGACTAAGAACCAAGT GTCCCTGACTTGCCTTGTCAAGGGC TTTTATCCGTCCGACATCGCCGTGG AGTGGGAGTCCAACGGACAACCGG AGAACAACTACAAGACCACCCCACC GGTGCTCGATTCCGATGGCTCCTTCT TCCTGTACTCCAAGCTGACTGTGGA CAAGTCAAGATGGCAGCAGGGAAA CGTGTTCTCCTGCTCCGTGATGCAC GAAGCGCTGCACAACCATTACACCC AGAAATCACTGTCACTTTCGCCGGG AAAA |
| SEQ ID 2236 | QVTLKESGGGVVQPGRSLRLSCAASGF IFSNYAIHWVRQAPGKGLEWVAVISY DGSNKYYADSVKGRFTISRDNSKNTL YLQMNSLRAEDTAVYYCARTFAGYSS KLGYFDLWGRGTLVTVSSASTKGPSV FPLAPSSKSTSGGTAALGCLVKDYFPE PVTVSWNSGALTSGVHTFPAVLQSSGL YSLSSVVTVPSSSLGTQTYICNVNHKPS NTKVDKKVEPKSCDKTHTCPPCPAPEL LGGPSVFLFPPKPKDTLMISRTPEVTCV VVDVSHEDPEVKFNWYVDGVEVHNA KTKPREEQYASTYRVVSVLTVLHQDW LNGKEYKCKVSNKALPAPIEKTISKAK | SEQ ID 2344 | CAGGTCACCTTGAAGGAGTCTGGGG GAGGCGTGGTCCAGCCTGGGAGGTC CCTGAGACTCTCCTGTGCAGCCTCT GGATTCATCTTCAGTAACTATGCTA TACACTGGGTCCGCCAGGCTCCAGG CAAGGGGCTGGAGTGGGTGGCAGTT ATATGGTATGATGGAAGTAATAAAT ACTACGCAGACTCCGTGAAGGGCCG ATTCACCATCTCCAGAGACAATTCC AAGAACACGCTGTATCTGCAAATGA ACAGCCTGAGAGCTGAGGACACGG CTGTGTATTACTGTGCGAGGACTTTT GCGGGGTATAGCAGCAAACTGGGG |

TABLE 40-continued

Anti-CLEC2D antibody IgG1 N to A Heavy chain amino acid and DNA sequence

| SEQ ID | VH + CH + AA_IgG1 N to A | SEQ ID | VH + CH + DNA_IgG1 N to A |
|---|---|---|---|
| | GQPREPQVYTLPPSREEMTKNQVSLTC LVKGFYPSDIAVEWESNGQPENNYKT TPPVLDSDGSFFLYSKLTVDKSRWQQG NVFSCSVMHEALHNHYTQKSLSLSPG K | | TACTTCGATCTCTGGGGCCGTGGCA CCCTGGTCACCGTCTCCTCAGCATC CACCAAGGGGCCTTCCGTGTTCCCC CTGGCCCCTTCATCCAAGTCGACCT CTGGTGGAACCGCCGCACTCGGTTG CCTGGTCAAAGACTACTTCCCCGAG CCCGTGACTGTCTCGTGGAACTCGG GCGCCCTCACATCCGGAGTGCATAC CTTTCCCGCCGTGTTGCAGTCCAGC GGCCTGTACAGCCTGAGCTCCGTCG TGACAGTGCCGTCTCCTCCCTTGG AACCCAGACCTATATCTGCAACGTC AATCACAAGCCCTCCAACACCAAAG TGGACAAGAAGGTCGAACCCAAGT CCTGCGACAAGACTCACACCTGTCC GCCTTGTCCAGCCCTGAGCTGCTG GGTGGTCCGTCCGTGTTCCTCTTCCC GCCCAAGCCGAAGGACACTCTGATG ATTTCACGCACCCCGGAAGTCACTT GCGTGGTCGTGGACGTGTCGCACGA AGATCCCGAAGTGAAATTCAATTGG TACGTGGATGGGGTCGAAGTGCACA ACGCCAAGACCAAGCCTAGGGAAG AACAGTACgccTCTACGTACCGGGTG GTGTCCGTGCTGACCGTGCTGCACC AGGACTGGCTGAACGGAAAGGAGT ACAAGTGCAAAGTGTCAAACAAGG CTCTCCCTGCCCCTATCGAAAAGAC CATCAGCAAGGCCAAGGGTCAACCT AGGGAGCCCCAGGTCTACACTTTGC CGCCTAGCCGGGAAGAAATGACTA AGAACCAAGTGTCCCTGACTTGCCT TGTCAAGGGCTTTTATCCGTCCGAC ATCGCCGTGGAGTGGGAGTCCAACG GACAACCGGAGAACAACTACAAGA CCACCCCACCGGTGCTCGATTCCGA TGGCTCCTTCTTCCTGTACTCCAAGC TGACTGTGGACAAGTCAAGGATGGCA GCAGGGAAACGTGTTCTCCTGCTCC GTGATGCACGAAGCGCTGCACAACC ATTACACCCAGAAATCACTGTCACT TTCGCCGGGAAAA |

TABLE 41

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2345 | EVQLVQSGAEVKKPGA SVKVSCKASGYTFTSYA MHWVRQAPGQRLEWM GWINAGNGNTKYSQKF QGRVTITRDTSASTAYM ELSSLRSEDTAVYYCAR GSLSRSGWYAGLFDYW GQGTLVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ | SEQ ID 2453 | GAAGTGCAGCTGGTGCAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGAGTG GATGGGATGGATCAACGCTGGCA ATGGTAACACAAAATATTCACAGA AGTTCCAGGGCAGAGTCACCATTA CCAGGGACACATCCGCGAGCACA GCCTACATGGAGCTGAGCAGCCT GAGATCTGAAGACACGGCTGTGTA TTACTGTGCGAGAGGCTCCTTGTC CCGAAGTGGCTGGTACGCCGGAC TCTTTGACTACTGGGGCCAGGGAA CCCTGGTCACCGTCTCCTCAGCAA GCACAAAAGGTCCTTCAGTGTTCC CTCTGGCACCTTGCTCACGCAGCA CCTCTGAGAGTACAGCCGCCCTG GGCTGCCTGGTAAAGGACTACTTT CCCGAACCAGTCACTGTGTCCTGG AATAGCGGGGCCTTGACCTCTGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | VSLTCLVKGFYPSDIAVE WESNGQPENNYKTTPP MLDSDGSFFLYSKLTVD KSRWQQGNVFSCSVM HEALHNHYTQKSLSLSP GK | | AGTGCACACATTTCCAGCTGTACT GCAGTCATCTGGACTCTACAGCCT GTCCAGTGTGGTCACCGTACCTTC CTCCAACTTTGGCACTCAAACATA TACATGTAACGTGGATCATAAGCC CTCTAACACCAAAGTGGATAAAAC TGTGGAGCGTAAGTGTTGTGTCGA GTGTCCTCCTTGTCCTGCTCCTCC TGTGGCAGGCCCATCTGTGTTTCT CTTTCCCCCAAAGCCAAAGGACAC TTTGATGATATCCCGGACCCCTGA GGTGACTTGCGTCGTCGTAGATGT TTCACACGAAGATCCAGAGGTGCA GTTCAACTGGTACGTGGATGGCGT GGAAGTGCATAATGCCAAGACAAA GCCCCGCGAAGAGCAGTTTAATTC CACCTTCCGCGTGGTGTCTGTGCT GACCGTGGTACATCAGGATTGGCT TAACGGTAAGGAGTACAAGTGCAA GGTGAGTAACAAGGGGCTGCCCG CCCCTATCGAGAAGACTATCAGTA AAACCAAGGGCCAGCCAAGGGAG CCACAGGTGTACACACTTCCACCA TCTAGGGAGGAAATGACAAAGAAC CAGGTGAGTTTGACCTGTCTCGTG AAAGGCTTTTATCCCAGTGATATA GCCGTGGAATGGGAAAGTAACGG GCAGCCCGAGAACAACTATAAGAC CACACCACCCATGCTGGACTCCGA CGGTTCTTTCTTCCTTTATAGCAAG CTGACAGTGGATAAATCCAGGTGG CAGCAGGGTAACGTATTCAGTTGC AGTGTCATGCACGAGGCACTCCAC AACCACTATACTCAGAAAAGTCTTT CCCTGAGTCCAGGCAAG |
| SEQ ID 2346 | QITLKESGGGVVQPGRS LRLSCAASGFTFSSYSM NWVRQAPGKGLQWVAI ISDDGSKSYYADSVQGR FTISRDNSRNTVFLQMN SLRAEDTAMYYCARDR GTKWNQLNDVFDMWG QGTMVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2454 | CAGATCACCTTGAAGGAGTCTGGG GGAGGCGTGGTCCAGCCTGGGAG GTCCCTGAGACTCTCCTGTGCAGC CTCTGGATTCACCTTCAGTAGTTAT AGCATGAACTGGGTCCGCCAGGC TCCAGGCAAGGGGCTGCAGTGGG TGGCAATTATATCAGATGATGGAA GTAAGAGTTACTACGCAGACTCCG TGCAGGGCCGATTCACCATCTCCA GAGACAATTCGAGGAACACAGTAT TTCTGCAAATGAACAGCCTGAGAG CTGAGGACACGGCTATGTATTACT GTGCAGAGACAGGGGAACTAAA TGGAACCAATTGAATGATGTTTTG ATATGTGGGGCCAAGGGACAATG GTCACCGTCTCTTCAGCAAGCACA AAAGGTCCTTCAGTGTTCCCTCTG GCACCTTGCTCACGCAGCACCTCT GAGAGTACAGCCGCCCTGGGCTG CCTGGTAAAGGACTACTTTCCCGA ACCAGTCACTGTGTCCTGGAATAG CGGGGCCTTGACCTCTGGAGTGC ACACATTTCCAGCTGTACTGCAGT CATCTGGACTCTACAGCCTGTCCA GTGTGGTCACCGTACCTTCCTCCA ACTTTGGCACTCAAACATATACAT GTAACGTGGATCATAAGCCCTCTA ACACCAAAGTGGATAAAACTGTGG AGCGTAAGTGTTGTGTCGAGTGTC CTCCTTGTCCTGCTCCTCCTGTGG CAGGCCCATCTGTGTTTCTCTTTC CCCAAAGCCAAAGGACACTTTGA TGATATCCCGGACCCCTGAGGTGA CTTGCGTCGTCGTAGATGTTTCAC ACGAAGATCCAGAGGTGCAGTTCA ACTGGTACGTGGATGGCGTGGAA GTGCATAATGCCAAGACAAAGCCC CGCGAAGAGCAGTTTAATTCCACC TTCCGCGTGGTGTCTGTGCTGACC GTGGTACATCAGGATTGGCTTAAC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GGTAAGGAGTACAAGTGCAAGGT GAGTAACAAGGGGCTGCCCGCCC CTATCGAGAAGACTATCAGTAAAA CCAAGGGCCAGCCAAGGGAGCCA CAGGTGTACACACTTCCACCATCT AGGGAGGAAATGACAAAGAACCA GGTGAGTTTGACCTGTCTCGTGAA AGGCTTTTATCCCAGTGATATAGC CGTGGAATGGGAAAGTAACGGGC AGCCCGAGAACAACTATAAGACCA CACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2347 | EVQLVQSGAEVKKPGA SVKVSCKASGYTFTSYY MHWVRQAPGQGLEWM GIINPSGGSTSYAQKFQ GRVTMTRDTSTSTVYM ELSSLRSEDTAVYYCAR GRGYSSSRLYYFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2455 | GAAGTGCAGCTGGTGCAGTCTGG GGCTGAGGTGAAGAAGCCTGGGG CCTCAGTGAAGGTTTCCTGCAAGG CATCTGGATACACCTTCACCAGCT ACTATATGCACTGGGTGCGACAGG CCCCTGGACAAGGGCTTGAGTGG ATGGGAATAATCAACCCTAGTGGT GGTAGCACAAGCTACGCACAGAA GTTCCAGGGCAGAGTCACCATGA CCAGGGACACGTCCACGAGCACA GTCTACATGGAGCTGAGCAGCCT GAGATCTGAGGACACGGCCGTGT ATTACTGTGCGAGAGGCCGAGGG TATAGCAGCAGTCGGCTCTACTAC TTTGACTACTGGGGCCAGGGAAC CCTGGTCACCGTCTCCTCAGCAAG CACAAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2348 | QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK | SEQ ID 2456 | CAGGTCACCTTGAAGGAGTCTGGGGGAGGCTTGGTCCGGCCTGGAGGTCCCTGAGACTCTCCTGTGAAGCCTCTGGATTCACCTTCAGTGACCCCTACATGGACTGGGTCCGCCAGGCTCCAGGCAAGGGGCTGGAGTGGGTTGGCCGAATTACAAATAAGCGTACCGGTTACGCCACAACATATGCCGCGTCTGTGAAGGACAGATTCACCATCTCAAGAGATGATTCAAGGAAGTCAGTATATCTGCAAATGAACAGCCTGAAGACCGAGGACACGGCCGTATATTATTGTGCAACAGATGTCAGTGGGTCCTTCGCGGCCTACGGGGGCCAGGGCACCCTGGTCACCGTCTCCTCAGCAAGCACAAAAGGTCCTTCAGTGTTCCCTCTGGCACCTTGCTCACGCAGCACCTCTGAGAGTACAGCCGCCCTGGGCTGCCTGGTAAAGGACTACTTTCCCGAACCAGTCACTGTGTCCTGGAATAGCGGGGCCTTGACCTCTGGAGTGCACACATTTCCAGCTGTACTGCAGTCATCTGGACTCTACAGCCTGTCCAGTGTGGTCACCGTACCTTCCTCCAACTTTGGCACTCAAACATATACATGTAACGTGGATCATAAGCCCTCTAACACCAAAGTGGATAAAACTGTGGAGCGTAAGTGTTGTGTCGAGTGTCCTCCTTGTCCTGCTCCTCCTGTGGCAGGCCCATCTGTGTTTCTCTTTCCCCCAAAGCCAAAGGACACTTTGATGATATCCCGGACCCCTGAGGTGACTTGCGTCGTCGTAGATGTTTCACACGAAGATCCAGAGGTGCAGTTCAACTGGTACGTGGATGGCGTGGAAGTGCATAATGCCAAGACAAAGCCCCGCGAAGAGCAGTTTAATTCCACCTTCCGCGTGGTGTCTGTGCTGACCGTGGTACATCAGGATTGGCTTAACGGTAAGGAGTACAAGTGCAAGGTGAGTAACAAGGGGCTGCCCGCCCCTATCGAGAAGACTATCAGTAAAACCAAGGGCCAGCCAAGGGAGCCACAGGTGTACACACTTCCACCATCTAGGGAGGAAATGACAAAGAACCAGGTGAGTTTGACCTGTCTCGTGAAAGGCTTTTATCCCAGTGATATAGCCGTGGAATGGGAAAGTAACGGGCAGCCCGAGAACAACTATAAGACCACACCCACCCATGCTGGACTCCGACGGTTCTTTCTTCCTTTTATAGCAAGCTGACAGTGGATAAATCCAGGTGGCAGCAGGGTAACGTATTCAGTTGCAGTGTCATGCACGAGGCACTCCACAACCACTATACTCAGAAAAGTCTTTCCCTGAGTCCAGGCAAG |
| SEQ ID 2349 | EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTF | SEQ ID 2457 | GAGGTCCAGCTGGTACAGTCTGGGGGAGGCGTGGTCCAGCCTGGGAGGTCCCTGAGACTCTCCTGTGCAGCGTCTGGATTCACCTTCAGTAGCTATGCTATGCATTGGGTGCGCCAGGCCCCCGGACAAAGGCTTGAGTGGATGGGATGGATCAACGCTGGCAATGGTAACACAAAATATTCACAGAAGTTCCAGGGCAGAGTCACCATTACCAGGGACACATCCGCGAGCACAGCCTACATGGAGCTGAGCAGCCTGAGATCTGAAGACACGGCTGTGTATTACTGTGCGGGAGAGGGCGGAGCAGTGGCTGGTACTGTCTACTGGGGCCAGGGAACCCTGGTCACCGTCTCCTCAGCAAGCACAAAAGGTCCTTCAGTGTTCCCTCTGGCACCTTGCTCACGCAGCACCTCTGAGAGTACA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | | GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2350 | QVQLVQSGGGLVKPGG SLRLSCAASGFTFSNAW MSWVRQAPGKGLEWV GRIKSKTDGGTTDYAAP VKGRFTISRDDSKNTLY LQMNSLKTEDTAVYYCT TDEYFYWGQGTLVTVS SASTKGPSVFPLAPCSR STSESTAALGCLVKDYF PEPVTVSWNSGALTSG VHTFPAVLQSSGLYSLS SVVTVPSSNFGTQTYTC NVDHKPSNTKVDKTVE RKCCVECPPCPAPPVA GPSVFLFPPKPKDTLMI SRTPEVTCVVVDVSHED PEVQFNWYVDGVEVHN AKTKPREEQFNSTFRVV SVLTVVHQDWLNGKEY KCKVSNKGLPAPIEKTIS KTKGQPREPQVYTLPPS REEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2458 | CAGGTCCAGCTGGTGCAGTCTGG GGGAGGCTTGGTAAAGCCTGGGG GGTCCCTTAGACTCTCCTGTGCAG CCTCTGGATTCACTTTCAGTAACG CCTGGATGAGCTGGGTCCGCCAG GCTCCAGGGAAGGGGCTGGAGTG GGTTGGCCGTATTAAAAGCAAAAC TGATGGTGGGACAACAGACTACG CTGCACCCGTGAAAGGCAGATTCA CCATCTCAAGAGATGATTCAAAA ACACGCTGTATCTGCAAATGAACA GCCTGAAAACCGAGGACACAGCC GTGTATTACTGTACCACAGACGAG TATTTCTACTGGGGCCAGGGAACC CTGGTCACCGTCTCCTCAGCAAGC ACAAAAGGTCCTTCAGTGTTCCCT CTGGCACCTTGCTCACGCAGCAC CTCTGAGAGTACAGCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCT GTCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CCCCGCGAAGAGCAGTTTAATTCC<br>ACCTTCCGCGTGGTGTCTGTGCTG<br>ACCGTGGTACATCAGGATTGGCTT<br>AACGGTAAGGAGTACAAGTGCAAG<br>GTGAGTAACAAGGGGCTGCCCGC<br>CCCTATCGAGAAGACTATCAGTAA<br>AACCAAGGGCCAGCCAAGGGAGC<br>CACAGGTGTACACACTTCCACCAT<br>CTAGGGAGGAAATGACAAAGAACC<br>AGGTGAGTTTGACCTGTCTCGTGA<br>AAGGCTTTTATCCCAGTGATATAG<br>CCGTGGAATGGGAAAGTAACGGG<br>CAGCCCGAGAACAACTATAAGACC<br>ACACCACCCATGCTGGACTCCGAC<br>GGTTCTTTCTTCCTTTATAGCAAGC<br>TGACAGTGGATAAATCCAGGTGGC<br>AGCAGGGTAACGTATTCAGTTGCA<br>GTGTCATGCACGAGGCACTCCACA<br>ACCACTATACTCAGAAAAGTCTTTC<br>CCTGAGTCCAGGCAAG |
| SEQ ID 2351 | QVQLQQWGAGLLKPSE<br>TLSLTCAVYGGSFSGYY<br>WSWIRQPPGKGLEWIG<br>EINHSGSTNYNPSLKSR<br>VTISVDTSKNQFSLKLSS<br>VTAADTAVYYCARVNP<br>GSYTREVSNFDYWGQG<br>TLVTVSSASTKGPSVFP<br>LAPCSRSTSESTAALGC<br>LVKDYFPEPVTVSWNS<br>GALTSGVHTFPAVLQSS<br>GLYSLSSVVTVPSSNFG<br>TQTYTCNVDHKPSNTKV<br>DKTVERKCCVECPPCP<br>APPVAGPSVFLFPPKPK<br>DTLMISRTPEVTCVVVD<br>VSHEDPEVQFNWYVDG<br>VEVHNAKTKPREEQFN<br>STFRVVSVLTVVHQDWL<br>NGKEYKCKVSNKGLPA<br>PIEKTISKTKGQPREPQV<br>YTLPPSREEMTKNQVSL<br>TCLVKGFYPSDIAVEWE<br>SNGQPENNYKTTPPML<br>DSDGSFFLYSKLTVDKS<br>RWQQGNVFSCSVMHE<br>ALHNHYTQKSLSLSPGK | SEQ ID 2459 | CAGGTGCAGCTACAGCAGTGGGG<br>CGCAGGACTGTTGAAGCCTTCGG<br>AGACCCTGTCCCTCACCTGCGCTG<br>TCTATGGTGGGTCCTTCAGTGGTT<br>ACTACTGGAGCTGGATCCGCCAG<br>CCCCCAGGGAAGGGGCTGGAGTG<br>GATTGGGGAAATCAATCATAGTGG<br>AAGCACCAACTACAACCCGTCCCT<br>CAAGAGTCGAGTCACCATATCAGT<br>AGACACGTCCAAGAACCAGTTCTC<br>CCTGAAGCTGAGCTCTGTGACCG<br>CCGCGGACACGGCTGTGTATTACT<br>GTGCGAGAGTAAATCCGGGGAGT<br>TATACGAGGGAGGTGAGCAACTTT<br>GACTACTGGGGCCAGGGAACCCT<br>GGTGACCGTCTCCTCAGCAAGCA<br>CAAAAGGTCCTTCAGTGTTCCCTC<br>TGGCACCTTGCTCACGCAGCACCT<br>CTGAGAGTACAGCCGCCCTGGGC<br>TGCCTGGTAAAGGACTACTTTCCC<br>GAACCAGTCACTGTGTCCTGGAAT<br>AGCGGGGCCTTGACCTCTGGAGT<br>GCACACATTTCCAGCTGTACTGCA<br>GTCATCTGGACTCTACAGCCTGTC<br>CAGTGTGGTCACCGTACCTTCCTC<br>CAACTTTGGCACTCAAACATATAC<br>ATGTAACGTGGATCATAAGCCCTC<br>TAACACCAAAGTGGATAAAACTGT<br>GGAGCGTAAGTGTTGTGTCGAGT<br>GTCCTCCTTGTCCTGCTCCTCCTG<br>TGGCAGGCCCATCTGTGTTTCTCT<br>TTCCCCCAAAGCCAAAGGACACTT<br>TGATGATATCCCGGACCCCTGAGG<br>TGACTTGCGTCGTCGTAGATGTTT<br>CACACGAAGATCCAGAGGTGCAG<br>TTCAACTGGTACGTGGATGGCGTG<br>GAAGTGCATAATGCCAAGACAAAG<br>CCCCGCGAAGAGCAGTTTAATTCC<br>ACCTTCCGCGTGGTGTCTGTGCTG<br>ACCGTGGTACATCAGGATTGGCTT<br>AACGGTAAGGAGTACAAGTGCAAG<br>GTGAGTAACAAGGGGCTGCCCGC<br>CCCTATCGAGAAGACTATCAGTAA<br>AACCAAGGGCCAGCCAAGGGAGC<br>CACAGGTGTACACACTTCCACCAT<br>CTAGGGAGGAAATGACAAAGAACC<br>AGGTGAGTTTGACCTGTCTCGTGA<br>AAGGCTTTTATCCCAGTGATATAG<br>CCGTGGAATGGGAAAGTAACGGG<br>CAGCCCGAGAACAACTATAAGACC<br>ACACCACCCATGCTGGACTCCGAC<br>GGTTCTTTCTTCCTTTATAGCAAGC<br>TGACAGTGGATAAATCCAGGTGGC<br>AGCAGGGTAACGTATTCAGTTGCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGTCATGCACGAGGCACTCCACA |
| | | | ACCACTATACTCAGAAAAGTCTTTC |
| | | | CCTGAGTCCAGGCAAG |
| SEQ ID 2352 | QVQLQQSGPELVKPSQ TLTLTCGISGDSVSSNS VTWNWVRQSPSRGLE WLGRTYYRSQWYYNYA VSVKSRITISPDTSKNQF SLQLNSVTPEDTAVYYC ATRGHNYGVDYWGPGT TVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2460 | CAGGTACAGCTGCAGCAGTCAGG TCCAGAATTGGTGAAGCCCTCGCA GACCCTCACACTCACCTGTGGCAT CTCCGGGGACAGTGTCTCTAGCAA CAGTGTTACTTGGAACTGGGTCAG GCAGTCCCCATCGAGAGGCCTTG AGTGGCTGGGAAGGACTTACTACC GGTCCCAGTGGTATTATAATTATG CGGTGTCTGTGAAAAGTCGAATAA CCATCAGCCCAGACACATCCAAGA ACCAGTTCTCCCTGCAGTTGAATT CTGTGACTCCCGAGGACACGGCT GTCTATTACTGTGCAACCAGGGGA CATAACTACGGTGTAGATTACTGG GGCCCGGGGACCACGGTCACCGT CTCCTCAGCAAGCACAAAGGGTCC TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2353 | QVQLVQSGGGLVKPGG SLRLSCAASGFTFSNAW MSWVRQAPGKGLEWV CRIKSKTDGETTDYAAP VKGRFTISRDDSKNTLY LQMNSLKTEDTAVHCT TGVGWSPFQYWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP | SEQ ID 2461 | CAGGTGCAGCTGGTGCAGTCTGG GGGAGGCTTGGTAAAGCCTGGGG GGTCCCTTAGACTCTCCTGTGCAG CCTCTGGATTCACTTTCAGTAACG CCTGGATGAGCTGGGTCCGCCAG GCTCCAGGGAAGGGGCTGGAGTG GGTTTGCCGTATTAAAAGCAAAAC TGATGGTGAGACAACAGACTACGC TGCACCCGTGAAAGGCAGATTCAC CATCTCAAGAGATGATTCAAAAAA CACGCTGTATCTGCAAATGAACAG CCTGAAAACTGAGGACACAGCCGT GTATCACTGTACCACAGGGGTGG GATGGTCGCCCTTCCAATACTGGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | | GCCAGGGCACCCTGGTCACCGTC TCCTCAGCAAGCACAAAAGGTCCT TCAGTGTTCCCTCTGGCACCTTGC TCACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2354 | EVQLVQSGGGLVQPGR SLRLSCTASGFTFGDYA MSWFRQAPGKGLEWV GFIRSKAYGGTTEYAAS VKGRFTISRDDSKSIAYL QMNSLKTEDTAVYYCT RDDKIAAAGFTYWYFDL WGRGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2462 | GAGGTCCAGCTGGTACAGTCTGG GGGAGGCTTGGTACAGCCAGGC GGTCCCTGAGACTCTCCTGTACAG CTTCTGGATTCACCTTTGGTGATTA TGCTATGAGCTGGTTCCGCCAGG CTCCAGGGAAGGGGCTGGAGTGG GTAGGTTTCATTAGAAGCAAAGCT TATGGTGGGACAACAGAATACGCC GCGTCTGTGAAAGGCAGATTCACC ATCTCAAGAGATGATTCCAAAAGC ATCGCCTATCTGCAAATGAACAGC CTGAAAACCGAGGACACAGCCGT GTATTACTGTACTAGAGACGACAA AATAGCAGCAGCTGGATTCACATA CTGGTACTTCGATCTCTGGGGCCG TGGCACCCTGGTCACCGTCTCCTC AGCAAGCACAAAAGGTCCTTCAGT GTTCCCTCTGGCACCTTGCTCACG CAGCACCTCTGAGAGTACAGCCG CCCTGGGCTGCCTGGTAAAGGAC TACTTTCCCGAACCAGTCACTGTG TCCTGGAATAGCGGGGCCTTGAC CTCTGGAGTGCACACATTTCCAGC TGTACTGCAGTCATCTGGACTCTA CAGCCTGTCCAGTGTGGTCACCGT ACCTTCCTCCAACTTTGGCACTCA AACATATACATGTAACGTGGATCA TAAGCCCTCTAACACCAAAGTGGA TAAAACTGTGGAGCGTAAGTGTTG TGTCGAGTGTCCTCCTTGTCCTGC TCCTCCTGTGGCAGGCCCATCTGT GTTTCTCTTTCCCCCAAAGCCAAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GGACACTTTGATGATATCCCGGAC CCCTGAGGTGACTTGCGTCGTCGT AGATGTTTCACACGAAGATCCAGA GGTGCAGTTCAACTGGTACGTGGA TGGCGTGGAAGTGCATAATGCCAA GACAAAGCCCCGCGAAGAGCAGT TTAATTCCACCTTCCGCGTGGTGT CTGTGCTGACCGTGGTACATCAGG ATTGGCTTAACGGTAAGGAGTACA AGTGCAAGGTGAGTAACAAGGGG CTGCCCGCCCCTATCGAGAAGACT ATCAGTAAAACCAAGGGCCAGCCA AGGGAGCCACAGGTGTACACACTT CCACCATCTAGGGAGGAAATGACA AAGAACCAGGTGAGTTTGACCTGT CTCGTGAAAGGCTTTTATCCCAGT GATATAGCCGTGGAATGGGAAAGT AACGGGCAGCCCGAGAACAACTA TAAGACCACACCCCCATGCTGGA CTCCGACGGTTCTTTCTTCCTTTAT AGCAAGCTGACAGTGGATAAATCC AGGTGGCAGCAGGGTAACGTATT CAGTTGCAGTGTCATGCACGAGG CACTCCACAACCACTATACTCAGA AAAGTCTTTCCCTGAGTCCAGGCA AG |
| SEQ ID 2355 | QVQLVQSGAEVKKPGA SVKVSCKASGYTFAAYY LHWVRQAPGQGLEWM GRISPGNGVTSYAQKFQ GRVTMTGDTSINTVYM QLNNLISGDTAVYYCAR EAADDPFDHWGQGALV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2463 | CAGGTGCAGCTGGTGCAGTCTGG GGCTGAGGTGAAGAAGCCTGGGG CCTCAGTGAAGGTCTCCTGCAAGG CTTCTGGATACACCTTCGCCGCCT ATTATTTACACTGGGTGCGACAGG CCCCTGGACAAGGCCTTGAGTGG ATGGGGCGGATCAGCCCCTGGTAA CGGTGTCACAAGTTATGCACAGAA ATTTCAGGGCAGAGTCACCATGAC CGGGGACACGTCCATTAACACAGT CTACATGCAACTGAACAATTTGATT TCTGGCGACACGGCCGTATATTAC TGTGCGAGAGAGGCTGCCGACGA CCCGTTTGACCATTGGGGCCAGG GAGCCCTGGTCACCGTCTCCTCA GCAAGCACAAAAGGTCCTTCAGTG TTCCCTCTGGCACCTTGCTCACGC AGCACCTCTGAGAGTACAGCCGC CCTGGGCTGCCTGGTAAAGGACT ACTTTCCCGAACCAGTCACTGTGT CCTGGAATAGCGGGGCCTTGACC TCTGGAGTGCACACATTTCCAGCT GTACTGCAGTCATCTGGACTCTAC AGCCTGTCCAGTGTGGTCACCGTA CCTTCCTCCAACTTTGGCACTCAA ACATATACATGTAACGTGGATCAT AAGCCCTCTAACACCAAAGTGGAT AAAACTGTGGAGCGTAAGTGTTGT GTCGAGTGTCCTCCTTGTCCTGCT CCTCCTGTGGCAGGCCCATCTGT GTTTCTCTTTCCCCCAAAGCCAAA GGACACTTTGATGATATCCCGGAC CCCTGAGGTGACTTGCGTCGTCGT AGATGTTTCACACGAAGATCCAGA GGTGCAGTTCAACTGGTACGTGGA TGGCGTGGAAGTGCATAATGCCAA GACAAAGCCCCGCGAAGAGCAGT TTAATTCCACCTTCCGCGTGGTGT CTGTGCTGACCGTGGTACATCAGG ATTGGCTTAACGGTAAGGAGTACA AGTGCAAGGTGAGTAACAAGGGG CTGCCCGCCCCTATCGAGAAGACT ATCAGTAAAACCAAGGGCCAGCCA AGGGAGCCACAGGTGTACACACTT CCACCATCTAGGGAGGAAATGACA AAGAACCAGGTGAGTTTGACCTGT CTCGTGAAAGGCTTTTATCCCAGT GATATAGCCGTGGAATGGGAAAGT AACGGGCAGCCCGAGAACAACTA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TAAGACCACACCACCCATGCTGGA CTCCGACGGTTCTTTCTTCCTTTAT AGCAAGCTGACAGTGGATAAATCC AGGTGGCAGCAGGGTAACGTATT CAGTTGCAGTGTCATGCACGAGG CACTCCACAACCACTATACTCAGA AAAGTCTTTCCCTGAGTCCAGGCA AG |
| SEQ ID 2356 | EVQLVQSGGGVVQPGR SLTLSCAASGFTFSSHL MHWVRQAPGKGLEWV AVISYDGTSKYYGDSVK GRFTISRDNSKNTLYLQ MNSLRAEDTAIYYCAKA DYKYDWGQGTLVTVSS ASTKGPSVFPLAPCSRS TSESTAALGCLVKDYFP EPVTVSWNSGALTSGV HTFPAVLQSSGLYSLSS VVTVPSSNFGTQTYTCN VDHKPSNTKVDKTVERK CCVECPPCPAPPVAGP SVFLFPPKPKDTLMISRT PEVTCVVVDVSHEDPEV QFNWYVDGVEVHNAKT KPREEQFNSTFRVVSVL TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | SEQ ID 2464 | GAAGTGCAGCTGGTGCAGTCTGG GGGAGGCGTGGTCCAGCCTGGGA GGTCCCTGACACTCTCCTGTGCAG CCTCTGGATTCACCTTCAGTTCCC ATCTTATGCACTGGGTCCGCCAGG CTCCAGGCAAGGGGCTGGAGTGG GTGGCAGTTATATCATATGATGGA ACTAGTAAATATTACGGAGACTCC GTGAAGGGCCGCTTCACCATCTCC AGAGACAATTCCAAGAACACGTTG TATCTGCAAATGAACAGCCTGCGA GCTGAAGACACGGCTATATATTAC TGTGCGAAAGCAGATTATAAATAT GACTGGGGCCAGGGAACCCTGGT CACCGTCTCCTCAGCAAGCACAAA AGGTCCTTCAGTGTTCCCTCTGGC ACCTTGCTCACGCAGCACCTCTGA GAGTACAGCCGCCCTGGGCTGCC TGGTAAAGGACTACTTTCCCGAAC CAGTCACTGTGTCCTGGAATAGCG GGGCCTTGACCTCTGGAGTGCAC ACATTTCCAGCTGTACTGCAGTCA TCTGGACTCTACAGCCTGTCCAGT GTGGTCACCGTACCTTCCTCCAAC TTTGGCACTCAAACATATACATGTA ACGTGGATCATAAGCCCTCTAACA CCAAAGTGGATAAAACTGTGGAGC GTAAGTGTTGTGTCGAGTGTCCTC CTTGTCCTGCTCCTCCTGTGGCAG GCCCATCTGTGTTTCTCTTTCCCC CAAAGCCAAAGGACACTTTGATGA TATCCCGGACCCCTGAGGTGACTT GCGTCGTCGTAGATGTTTCACACG AAGATCCAGAGGTGCAGTTCAACT GGTACGTGGATGGCGTGGAAGTG CATAATGCCAAGACAAAGCCCCGC GAAGAGCAGTTTAATTCCACCTTC CGCGTGGTGTCTGTGCTGACCGT GGTACATCAGGATTGGCTTAACGG TAAGGAGTACAAGTGCAAGGTGAG TAACAAGGGGCTGCCCGCCCCTA TCGAGAAGACTATCAGTAAAACCA AGGGCCAGCCAAGGGAGCCACAG GTGTACACACTTCCACCATCTAGG GAGGAAATGACAAAGAACCAGGT GAGTTTGACCTGTCTCGTGAAAGG CTTTTATCCCAGTGATATAGCCGT GGAATGGGAAAGTAACGGGCAGC CCGAGAACAACTATAAGACCACAC CACCCATGCTGGACTCCGACGGTT CTTTCTTCCTTTATAGCAAGCTGAC AGTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2357 | EVQLVQSGGGLVKPGG SLRLSCTASGFTFGDYA MSWVRQAPGKGLEWV GFIRSKAYGGTTEYAAS VKGRFTISRDDSKSIAYL QMNSLKTEDTAVYYCTT HRRPIYDILTGFDYWGQ GTLVTVSSASTKGPSVF PLAPCSRSTSESTAALG CLVKDYFPEPVTVSWN | SEQ ID 2465 | GAGGTGCAGCTGGTGCAGTCTGG GGGAGGCTTGGTCAAGCCTGGAG GGTCCCTGAGACTCTCCTGTACAG CTTCTGGATTCACCTTTGGTGATTA TGCTATGAGCTGGGTCCGCCAGG CTCCAGGGAAGGGGCTGGAGTGG GTAGGTTTCATTAGAAGCAAAGCT TATGGTGGGACAACAGAATACGCC GCGTCTGTGAAAGGCAGATTCACC ATCTCAAGAGATGATTCCAAAAGC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | SGALTSGVHTFPAVLQS SGLYSLSSVVTVPSSNF GTQTYTCNVDHKPSNT KVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | ATCGCCTATCTGCAAATGAACAGC CTGAAAACCGAGGACACAGCCGT GTATTACTGTACTACTCATAGACG CCCAATTTACGATATTTTGACTGGT TTTGACTACTGGGGCCAGGGAAC CCTGGTCACCGTCTCCTCAGCAAG CACAAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2358 | QLQLQESGGGLVQPGR SLRLSCTASGFTFGDYA MSWVRQAPGKGLEWV GFIRSKAYGGTTEYAAS VKGRFTISRDDSKSIAYL QMNSLKTEDTAVYYCT REDTMVRGVIPWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2466 | CAGCTGCAGCTGCAGGAGTCCGG GGGAGGCTTGGTACAGCCAGGGC GGTCCCTGAGACTCTCCTGTACAG CTTCTGGATTCACCTTTGGTGATTA TGCTATGAGCTGGGTCCGCCAGG CTCCAGGGAAGGGGCTGGAGTGG GTAGGTTTCATTAGAAGCAAAGCT TATGGTGGGACAACAGAATACGCC GCGTCTGTGAAAGGCAGATTCACC ATCTCAAGAGATGATTCCAAAAGC ATCGCCTATCTGCAAATGAACAGC CTGAAAACCGAGGACACAGCCGT GTATTACTGTACTAGAGAGGATAC TATGGTTCGGGGAGTTATTCCCTG GGGCCAGGGAACCCTGGTCACCG TCTCCTCAGCAAGCACAAAAGGTC CTTCAGTGTTCCCTCTGGCACCTT GCTCACGCAGCACCTCTGAGAGTA CAGCCGCCCTGGGCTGCCTGGTA AAGGACTACTTTCCCGAACCAGTC ACTGTGTCCTGGAATAGCGGGGC CTTGACCTCTGGAGTGCACACATT TCCAGCTGTACTGCAGTCATCTGG ACTCTACAGCCTGTCCAGTGTGGT CACCGTACCTTCCTCCAACTTTGG CACTCAAACATATACATGTAACGT GGATCATAAGCCCTCTAACACCAA AGTGGATAAAACTGTGGAGCGTAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGTTGTGTCGAGTGTCCTCCTTG TCCTGCTCCTCCTGTGGCAGGCC CATCTGTGTTTCTCTTTCCCCCAAA GCCAAAGGACACTTTGATGATATC CCGGACCCCTGAGGTGACTTGCG TCGTCGTAGATGTTTCACACGAAG ATCCAGAGGTGCAGTTCAACTGGT ACGTGGATGGCGTGGAAGTGCAT AATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2359 | QLQLQESGSGLVKPSQ TLSLTCAVSGGSISSGG YSWSWIRQPPGKGLEW IGYIYHSGSTYYNPSLKS RVTISVDRSKNQFSLKL SSVTAADTAVYYCARDR RYYDSSGYYPAYYFDY WGQGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2467 | CAGCTGCAGCTGCAGGAGTCCGG CTCAGGACTGGTGAAGCCTTCACA GACCCTGTCCCTCACCTGCGCTGT CTCTGGTGGCTCCATCAGCAGTG GTGGTTACTCCTGGAGCTGGATCC GGCAGCCACCAGGGAAGGGCCTG GAGTGGATTGGGTACATCTATCAT AGTGGGAGCACCTACTACAACCC GTCCCTCAAGAGTCGAGTCACCAT ATCAGTAGACAGGTCCAAGAACCA GTTCTCCCTGAAGCTGAGCTCTGT GACCGCCGCGGACACGGCTGTGT ATTACTGTGCGAGAGATCGGCGTT ACTATGATAGTAGTGGTTATTATCC CGCCTACTACTTTGACTACTGGGG CCAGGGAACCCTGGTCACCGTCT CCTCAGCAAGCACAAAAGGTCCTT CAGTGTTCCCTCTGGCACCTTGCT CACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCGGAGTCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAGTCTTTCCCTGAGTCC AGGCAAG |
| SEQ ID 2360 | EVQLVQSGGGLVKPGG SLRLSCAASGFTFSSYS MNWVRQAPGKGLEWV SYISSSGSYTNYADSVK GRFTISRDNAKNSLYLQI NSLRAEDTAIYYCARDG GYDSSGFHFDYWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2468 | GAAGTGCAGCTGGTGCAGTCTGG GGGAGGCCTGGTCAAGCCTGGGG GGTCCCTGAGACTCTCCTGTGCAG CCTCTGGATTCACCTTCAGTAGCT ATAGCATGAACTGGGTCCGCCAG GCTCCAGGGAAGGGGCTGGAGTG GGTTTCATACATTAGTAGTAGTGG TAGTTACACAAACTACGCAGACTC TGTGAAGGGCCGATTCACCATCTC CAGAGACAACGCCAAGAACTCACT GTATCTGCAAATAAACAGCCTGAG AGCCGAGGACACGGCCATTTATTA CTGTGCGAGAGACGGGGGCTATG ATAGTAGTGGTTTTCACTTTGACTA CTGGGGCCAGGGAACCCTGGTCA CCGTCTCCTCAGCAAGCACAAAAG GTCCTTCAGTGTTCCCTCTGGCAC CTTGCTCACGCAGCACCTCTGAGA GTACAGCCGCCCTGGGCTGCCTG GTAAAGGACTACTTTCCCGAACCA GTCACTGTGTCCTGGAATAGCGG GGCCTTGACCTCTGGAGTGCACA CATTTCCAGCTGTACTGCAGTCAT CTGGACTCTACAGCCTGTCCAGTG TGGTCACCGTACCTTCCTCCAACT TTGGCACTCAAACATATACATGTAA CGTGGATCATAAGCCCTCTAACAC CAAAGTGGATAAAACTGTGGAGCG TAAGTGTTGTGTCGAGTGTCCTCC TTGTCCTGCTCCTCCTGTGGCAGG CCCATCTGTGTTTCTCTTTCCCCC AAAGCCAAAGGACACTTTGATGAT ATCCCGGACCCCTGAGGTGACTT GCGTCGTCGTAGATGTTTCACACG AAGATCCAGAGGTGCAGTTCAACT GGTACGTGGATGGCGTGGAAGTG CATAATGCCAAGACAAAGCCCCGC GAAGAGCAGTTTAATTCCACCTTC CGCGTGGTGTCTGTGCTGACCGT GGTACATCAGGATTGGCTTAACGG TAAGGAGTACAAGTGCAAGGTGAG TAACAAGGGGCTGCCCGCCCCTA TCGAGAAGACTATCAGTAAAACCA AGGGCCAGCCAAGGGAGCCACAG GTGTACACACTTCCACCATCTAGG GAGGAAATGACAAAGAACCAGGT GAGTTTGACCTGTCTCGTGAAAGG CTTTTATCCCAGTGATATAGCCGT GGAATGGGAAAGTAACGGGCAGC CCGAGAACAACTATAAGACCACAC CACCCATGCTGGACTCCGACGGTT CTTTCTTCCTTTATAGCAAGCTGAC AGTGGATAAATCCAGGTGGCAGCA GGGTAACGTATTCAGTTGCAGTGT CATGCACGAGGCACTCCACAACCA CTATACTCAGAAAGTCTTTCCCT GAGTCCAGGCAAG |
| SEQ ID 2361 | QVQLQQSGPGLVKPSQ TLSLTCAISGDSVSNNR AAWNWIRQSPSRGLEW LGRTYYRSKWYNEYAV SVKSRITINPDTSKNQFS | SEQ ID 2469 | CAGGTACAGCTGCAGCAGTCAGG TCCAGGACTGGTGAAGCCCTCGC AGACCCTCTCACTCACCTGTGCCA TCTCCGGGGACAGTGTCTCTAACA ACAGGGCTGCTTGGAACTGGATCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | LQLNSMTPEDSAVYYCA ILPSSGYLQDHHYYGMD VWGQGTTVTVSSASTK GPSVFPLAPCSRSTSES TAALGCLVKDYFPEPVT VSWNSGALTSGVHTFP AVLQSSGLYSLSSVVTV PSSNFGTQTYTCNVDH KPSNTKVDKTVERKCCV ECPPCPAPPVAGPSVFL FPPKPKDTLMISRTPEV TCVVVDVSHEDPEVQF NWYVDGVEVHNAKTKP REEQFNSTFRVVSVLTV VHQDWLNGKEYKCKVS NKGLPAPIEKTISKTKGQ PREPQVYTLPPSREEMT KNQVSLTCLVKGFYPSD IAVEWESNGQPENNYK TTPPMLDSDGSFFLYSK LTVDKSRWQQGNVFSC SVMHEALHNHYTQKSL SLSPGK | | GGCAGTCGCCATCGAGAGGCCTT GAGTGGCTGGGAAGGACATACTA CAGGTCCAAGTGGTATAATGAATA TGCAGTCTCTGTGAAAAGTCGAAT AACCATCAACCCAGACACATCCAA GAACCAGTTCTCCCTGCAGCTGAA CTCTATGACTCCCGAGGACTCGGC TGTGTATTACTGTGCAATTTTGCCT AGTAGTGGTTATCTACAGGACCAC CACTACTACGGTATGGACGTCTGG GGCCAAGGGACCACGGTCACCGT CTCCTCAGCAAGCACAAAAGGTCC TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2362 | EVQLVQSGAEVKKPGA SVKVSCKASGYTFTSYG ISWVRQAPGQGLEWMG WISAYNGNTNYAQKLQ GRVTMTTDTSTSTAYM ELSSLRSEDTAVYYCAR AAVGDGYSYGRLDWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ | SEQ ID 2470 | GAGGTGCAGCTGGTGCAGTCTGG AGCTGAGGTGAAGAAGCCTGGGG CCTCAGTGAAGGTCTCCTGCAAGG CTTCTGGTTACACCTTTACCAGCT ACGGTATCAGCTGGGTGCGACAG GCCCCTGGACAAGGGCTTGAGTG GATGGGATGGATCAGCGCTTACAA TGGTAACACAAACTATGCACAGAA GCTCCAGGGCAGAGTCACCATGA CCACAGACACATCCACGAGCACA GCCTACATGGAGCTGAGCAGCCT GAGATCTGAGGACACGGCCGTGT ATTACTGTGCGAGAGCGCGGTG GGGGATGGATACAGCTATGGTCG GCTCGATTGGGGCCAGGGAACCC TGGTCACCGTCTCCTCAGCAAGCA CAAAAGGTCCTTCAGTGTTCCCTC TGGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | VSLTCLVKGFYPSDIAVE<br>WESNGQPENNYKTTPP<br>MLDSDGSFFLYSKLTVD<br>KSRWQQGNVFSCSVM<br>HEALHNHYTQKSLSLSP<br>GK | | GCACACATTTCCAGCTGTACTGCA<br>GTCATCTGGACTCTACAGCCTGTC<br>CAGTGTGGTCACCGTACCTTCCTC<br>AACTTTGGCACTCAAACATATAC<br>ATGTAACGTGGATCATAAGCCCTC<br>TAACACCAAAGTGGATAAAACTGT<br>GGAGCGTAAGTGTTGTGTCGAGT<br>GTCCTCCTTGTCCTGCTCCTCCTG<br>TGGCAGGCCCATCTGTGTTTCTCT<br>TTCCCCCAAAGCCAAAGGACACTT<br>TGATGATATCCCGGACCCCTGAGG<br>TGACTTGCGTCGTCGTAGATGTTT<br>CACACGAAGATCCAGAGGTGCAG<br>TTCAACTGGTACGTGGATGGCGTG<br>GAAGTGCATAATGCCAAGACAAAG<br>CCCCGCGAAGAGCAGTTTAATTCC<br>ACCTTCCGCGTGGTGTCTGTGCTG<br>ACCGTGGTACATCAGGATTGGCTT<br>AACGGTAAGGAGTACAAGTGCAAG<br>GTGAGTAACAAGGGGCTGCCCGC<br>CCCTATCGAGAAGACTATCAGTAA<br>AACCAAGGGCCAGCCAAGGGAGC<br>CACAGGTGTACACACTTCCACCAT<br>CTAGGGAGGAAATGACAAAGAACC<br>AGGTGAGTTTGACCTGTCTCGTGA<br>AAGGCTTTTATCCCAGTGATATAG<br>CCGTGGAATGGGAAAGTAACGGG<br>CAGCCCGAGAACAACTATAAGACC<br>ACACCACCCATGCTGGACTCCGAC<br>GGTTCTTTCTTCCTTTATAGCAAGC<br>TGACAGTGGATAAATCCAGGTGGC<br>AGCAGGGTAACGTATTCAGTTGCA<br>GTGTCATGCACGAGGCACTCCACA<br>ACCACTATACTCAGAAAAGTCTTTC<br>CCTGAGTCCAGGCAAG |
| SEQ ID<br>2363 | EVQLVQSGAEVKKPGE<br>SLKISCKGSGYSFTSYW<br>IGWVRQMPGKGLEWM<br>GIIYPGDSDTRYSPSFQ<br>GQVTISADKSISTAYLQ<br>WSSLKASDTAMYYCAR<br>LPSYYYDSSGYFTWYF<br>DLWGRGTLVTVSSAST<br>KGPSVFPLAPCSRSTSE<br>STAALGCLVKDYFPEPV<br>TVSWNSGALTSGVHTF<br>PAVLQSSGLYSLSSVVT<br>VPSSNFGTQTYTCNVD<br>HKPSNTKVDKTVERKC<br>CVECPPCPAPPVAGPS<br>VFLFPPKPKDTLMISRTP<br>EVTCVVVDVSHEDPEV<br>QFNWYVDGVEVHNAKT<br>KPREEQFNSTFRVVSVL<br>TVVHQDWLNGKEYKCK<br>VSNKGLPAPIEKTISKTK<br>GQPREPQVYTLPPSRE<br>EMTKNQVSLTCLVKGFY<br>PSDIAVEWESNGQPEN<br>NYKTTPPMLDSDGSFFL<br>YSKLTVDKSRWQQGNV<br>FSCSVMHEALHNHYTQ<br>KSLSLSPGK | SEQ ID<br>2471 | GAGGTCCAGCTGGTACAGTCTGG<br>AGCAGAGGTGAAAAAGCCCGGGG<br>AGTCTCTGAAGATCTCCTGTAAGG<br>GTTCTGGATACAGCTTTACCAGCT<br>ACTGGATCGGCTGGGTGCGCCAG<br>ATGCCCGGGAAAGGCCTGGAGTG<br>GATGGGGATCATCTATCCTGGTGA<br>CTCTGATACCAGATACAGCCCGTC<br>CTTCCAAGGCCAGGTCACCATCTC<br>AGCCGACAAGTCCATCAGCACCG<br>CCTACCTGCAGTGGAGCAGCCTG<br>AAGGCCTCGGACACCGCCATGTAT<br>TACTGTGCGAGACTCCCCTCGTAT<br>TACTATGATAGTAGTGGTTACTTTA<br>CCTGGTACTTCGATCTCTGGGGCC<br>GTGGCACCCTGGTGACCGTCTCTT<br>CAGCAAGCACAAAAGGTCCTTCAG<br>TGTTCCCTCTGGCACCTTGCTCAC<br>GCAGCACCTCTGAGAGTACAGCC<br>GCCCTGGGCTGCCTGGTAAAGGA<br>CTACTTTCCCGAACCAGTCACTGT<br>GTCCTGGAATAGCGGGGCCTTGA<br>CCTCTGGAGTGCACACATTTCCAG<br>CTGTACTGCAGTCATCTGGACTCT<br>ACAGCCTGTCCAGTGTGGTCACC<br>GTACCTTCCTCCAACTTTGGCACT<br>CAAACATATACATGTAACGTGGAT<br>CATAAGCCCTCTAACACCAAAGTG<br>GATAAAACTGTGGAGCGTAAGTGT<br>TGTGTCGAGTGTCCTCCTTGTCCT<br>GCTCCTCCTGTGGCAGGCCCATCT<br>GTGTTTCTCTTTCCCCCAAAGCCA<br>AAGGACACTTTGATGATATCCCGG<br>ACCCCTGAGGTGACTTGCGTCGTC<br>GTAGATGTTTCACACGAAGATCCA<br>GAGGTGCAGTTCAACTGGTACGTG<br>GATGGCGTGGAAGTGCATAATGC<br>CAAGACAAAGCCCCGCGAAGAGC<br>AGTTTAATTCCACCTTCCGCGTGG<br>TGTCTGTGCTGACCGTGGTACATC |

845
846

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGGATTGGCTTAACGGTAAGGAGT
ACAAGTGCAAGGTGAGTAACAAGG
GGCTGCCCGCCCCTATCGAGAAG
ACTATCAGTAAAACCAAGGGCCAG
CCAAGGGAGCCACAGGTGTACAC
ACTTCCACCATCTAGGGAGGAAAT
GACAAAGAACCAGGTGAGTTTGAC
CTGTCTCGTGAAAGGCTTTTATCC
CAGTGATATAGCCGTGGAATGGGA
AAGTAACGGGCAGCCCGAGAACA
ACTATAAGACCACACCACCCATGC
TGGACTCCGACGGTTCTTTCTTCC
TTTATAGCAAGCTGACAGTGGATA
AATCCAGGTGGCAGCAGGGTAAC
GTATTCAGTTGCAGTGTCATGCAC
GAGGCACTCCACAACCACTATACT
CAGAAAAGTCTTTCCCTGAGTCCA
GGCAAG |
| SEQ ID 2364 | EVQLVQSGAEVKKPGA
SVKVSCKASGYTFTSYG
ISWVRQAPGQGLEWMG
WIIPIFGIANYAQKFQGR
VTITADKSTSTAYMELSS
LRSEDTAVYYCARELYN
YGSKDYFDYWGQGTLV
TVSSASTKGPSVFPLAP
CSRSTSESTAALGCLVK
DYFPEPVTVSWNSGAL
TSGVHTFPAVLQSSGLY
SLSSVVTVPSSNFGTQT
YTCNVDHKPSNTKVDKT
VERKCCVECPPCPAPP
VAGPSVFLFPPKPKDTL
MISRTPEVTCVVVDVSH
EDPEVQFNWYVDGVEV
HNAKTKPREEQFNSTFR
VVSVLTVVHQDWLNGK
EYKCKVSNKGLPAPIEK
TISKTKGQPREPQVYTL
PPSREEMTKNQVSLTCL
VKGFYPSDIAVEWESNG
QPENNYKTTPPMLDSD
GSFFLYSKLTVDKSRW
QQGNVFSCSVMHEALH
NHYTQKSLSLSPGK | SEQ ID 2472 | GAGGTCCAGCTGGTACAGTCTGG
AGCTGAGGTGAAGAAGCCTGGGG
CCTCAGTGAAGGTCTCCTGCAAGG
CTTCTGGTTACACCTTTACCAGCT
ATGGTATCAGCTGGGTGCGACAG
GCCCCTGGACAAGGGCTTGAGTG
GATGGGATGGATCATCCCTATCTT
TGGTATAGCAAACTACGCACAGAA
GTTCCAGGGCAGAGTCACGATTAC
CGCGGACAAATCCACGAGCACAG
CCTACATGGAGCTGAGCAGCCTG
AGATCTGAGGACACGGCCGTGTAT
TACTGTGCGAGAGAACTATACAAC
TATGGTTCAAAGGACTACTTTGAC
TACTGGGGCCAGGGAACCCTGGT
CACCGTCTCCTCAGCAAGCACAAA
AGGTCCTTCAGTGTTCCCTCTGGC
ACCTTGCTCACGCAGCACCTCTGA
GAGTACAGCCGCCCTGGGCTGCC
TGGTAAAGGACTACTTTCCCGAAC
CAGTCACTGTGTCCTGGAATAGCG
GGGCCTTGACCTCTGGAGTGCAC
ACATTTCCAGCTGTACTGCAGTCA
TCTGGACTCTACAGCCTGTCCAGT
GTGGTCACCGTACCTTCCTCCAAC
TTTGGCACTCAAACATATACATGTA
ACGTGGATCATAAGCCCTCTAACA
CCAAAGTGGATAAAACTGTGGAGC
GTAAGTGTTGTGTCGAGTGTCCTC
CTTGTCCTGCTCCTCCTGTGGCAG
GCCCATCTGTGTTTCTCTTTCCCC
CAAAGCCAAAGGACACTTTGATGA
TATCCCGGACCCCTGAGGTGACTT
GCGTCGTCGTAGATGTTTCACACG
AAGATCCAGAGGTGCAGTTCAACT
GGTACGTGGATGGCGTGGAAGTG
CATAATGCCAAGACAAAGCCCCGC
GAAGAGCAGTTTAATTCCACCTTC
CGCGTGGTGTCTGTGCTGACCGT
GGTACATCAGGATTGGCTTAACGG
TAAGGAGTACAAGTGCAAGGTGAG
TAACAAGGGGCTGCCCGCCCCTA
TCGAGAAGACTATCAGTAAAACCA
AGGGCCAGCCAAGGGAGCCACAG
GTGTACACACTTCCACCATCTAGG
GAGGAAATGACAAAGAACCAGGT
GAGTTTGACCTGTCTCGTGAAAGG
CTTTTATCCCAGTGATATAGCCGT
GGAATGGGAAAGTAACGGGCAGC
CCGAGAACAACTATAAGACCACAC
CACCCATGCTGGACTCCGACGGTT
CTTTCTTCCTTTATAGCAAGCTGAC
AGTGGATAAATCCAGGTGGCAGCA
GGGTAACGTATTCAGTTGCAGTGT
CATGCACGAGGCACTCCACAACCA
CTATACTCAGAAAAGTCTTTCCCT
GAGTCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2365 | EVQLVQSGAEVKKPGE SLKISCKGSGYSFTSYW IGWVRQMPGKGLEWM GIIYPGDSDTRYSPSFQ GQVTISADKSISTAYLQ WSSLKASDTAMYYCAR GGTWDTAMVTGFDYW GQGTLVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2473 | GAAGTGCAGCTGGTGCAGTCTGG AGCAGAGGTGAAAAGCCCGGGG AGTCTCTGAAGATCTCCTGTAAGG GTTCTGGATACAGCTTTACCAGCT ACTGGATCGGCTGGGTGCGCCAG ATGCCCGGGAAAGGCCTGGAGTG GATGGGGATCATCTATCCTGGTGA CTCTGATACCAGATACAGCCCGTC CTTCCAAGGCCAGGTCACCATCTC AGCCGACAAGTCCATCAGCACCG CCTACCTGCAGTGGAGCAGCCTG AAGGCCTCGGACACCGCCATGTAT TACTGTGCGAGGGGCGGTACTTG GGATACAGCTATGGTTACGGGCTT TGACTACTGGGGCCAGGGAACCC TGGTCACCGTCTCCTCAGCAAGCA CAAAAGGTCCTTCAGTGTTCCCTC TGGCACCTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2366 | EVQLVQSGAEVKKPGE SLKISCKGSGYSFTSYW IAWVRQMPGKGLEWM GVIYPGDSDTRYSPSFQ GQVTISADKSINTAYLQ WSSLKASDTAMYYCAR PHYDILTGSRAPFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV | SEQ ID 2474 | GAAGTGCAGCTGGTGCAGTCTGG AGCAGAGGTGAAAAGCCCGGGG AGTCTCTGAAGATCTCCTGTAAGG GTTCTGGATACAGCTTTACCAGCT ACTGGATCGCTGGGTGCGCCAG ATGCCCGGGAAAGGCCTGGAGTG GATGGGGGTCATCTATCCTGGTGA CTCTGATACCAGATACAGCCCGTC CTTCCAAGGCCAGGTCACCATCTC AGCCGACAAGTCCATCAATACCGC CTACCTGCAGTGGAGCAGCCTGA AGGCCTCGGACACCGCCATGTATT ACTGTGCGAGACCCCATTACGATA TTTTGACTGGTTCCGGGCGCCCT TTGACTACTGGGGCCAGGGAACC CTGGTCACCGTCTCCTCAGCAAGC ACAAAAGGTCCTTCAGTGTTCCCT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | CTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2367 | QVQLQQWGAGLLKPSE TLSLTCAVYGGSFSGYY WSWIRQPPGKGLEWIG EINHSGSTNYNPSLKSR VTISVDTSKNQFSLKLSS VTAADTAVYYCARARVE SKDGYFDYWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2475 | CAGGTGCAGCTACAGCAGTGGGG CGCAGGACTGTTGAAGCCTTCGG AGACCCTGTCCCTCACCTGCGCTG TCTATGGTGGGTCCTTCAGTGGTT ACTACTGGAGCTGGATCCGCCAG CCCCCAGGGAAGGGGCTGGAGTG GATTGGGGAAATCAATCATAGTGG AAGCACCAACTACAACCCGTCCCT CAAGAGTCGAGTCACCATATCAGT AGACACGTCCAAGAACCAGTTCTC CCTGAAGCTGAGCTCTGTGACCG CCGCGGACACGGCTGTGTATTACT GTGCGAGAGCCCGAGTGGAATCC AAGGATGGGTACTTTGACTACTGG GGCCAGGGAACCCTGGTCACCGT CTCCTCAGCAAGCACAAAAGGTCC TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2368 | EVQLVESGGGVVQPGR SLRLSCAASGFTFTDAW MNWWRQAPGKGLEWIG RVKNKADGETTDYAAP VKGRITISRDDAKNTLYV QMNSLKTEDTAVYYCTA DLRLSTWDAYDFWGQG TMVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2476 | GAGGTGCAGCTGGTGGAGTCTGG GGGAGGCGTGGTCCAGCCTGGGA GGTCCCTGAGACTCTCCTGTGCAG CCTCTGGATTCACTTTCACTGATG CCTGGATGAACTGGGTCCGCCAG GCTCCAGGGAAGGGGCTGGAGTG GATTGGCCGTGTTAAAAACAAAGC TGATGGTGAGACAACGGACTACG CTGCACCCGTCAAAGGCAGAATCA CCATCTCAAGAGATGATGCAAAGA ACACTCTGTATGTGCAAATGAACA GCCTGAAAACCGAGGACACAGCC GTGTATTATTGTACCGCTGACCTG CGACTTTCTACGTGGGATGCTTAT GATTTCTGGGGCCAAGGGACAAT GGTCACCGTCTCTTCAGCAAGCAC AAAAGGTCCTTCAGTGTTCCCTCT GGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2369 | QITLKESGGGLVQPGGS LRLSCTVSGFTFSNNW MTWVRQTPGKGLEWV ANIKQDGTEKHYVDSVK GRFTISRDNAENSLYLQ MNSLRGEDTAVYYCAR NSQRSFDYWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2477 | CAGATCACCTTGAAGGAGTCTGGG GGAGGCTTGGTCCAGCCTGGGGG GTCCCTAAGACTCTCTTGTACAGT CTCAGGATTCACCTTTAGTAACAAT TGGATGACCTGGGTCCGCCAGAC TCCAGGGAAGGGGCTGGAGTGGG TGGCCAACATAAAGCAAGATGGAA CTGAGAAACACTATGTGGACTCTG TGAAGGGCCGATTCACCATCTCCA GAGACAACGCCGAGAACTCACTGT ATCTGCAGATGAACAGCCTGAGAG GTGAGGACACGGCCGTGTATTATT GTGCGAGAAACAGTCAACGTTCGT TTGACTACTGGGGCCAGGGCACC CTGGTGACCGTCTCCTCAGCAAGC ACAAAAGGTCCTTCAGTGTTCCCT CTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2370 | QVTLKESGGGVVQPGR SLRLSCAASGFTFSSYG MHWVRQAPGKGLEWV AVISYDGSNKYYADSVK GRFTISRDNSKNTLYLQ MNSLRAEDTAVYYCAK DLGDPRGGILNYWGQG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP | SEQ ID 2478 | CAGGTCACCTTGAAGGAGTCTGG GGGAGGCGTGGTCCAGCCTGGGA GGTCCCTGAGACTCTCCTGTGCAG CCTCTGGATTCACCTTCAGTAGCT ATGGCATGCACTGGGTCCGCCAG GCTCCAGGCAAGGGGCTGGAGTG GGTGGCAGTTATATCATATGATGG AAGTAATAAATACTATGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAAAGATTAGGGGATCC CCGGGGTGGTATTTTGAACTACTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | | GGGCCAGGGCACCCTGGTCACCG TCTCCTCAGCAAGCACAAAAGGTC CTTCAGTGTTCCCTCTGGCACCTT GCTCACGCAGCACCTCTGAGGATA CAGCCGCCCTGGGCTGCCTGGTA AAGGACTACTTTCCCGAACCAGTC ACTGTGTCCTGGAATAGCGGGGC CTTGACCTCTGGAGTGCACACATT TCCAGCTGTACTGCAGTCATCTGG ACTCTACAGCCTGTCCAGTGTGGT CACCGTACCTTCCTCCAACTTTGG CACTCAAACATATACATGTAACGT GGATCATAAGCCCTCTAACACCAA AGTGGATAAAACTGTGGAGCGTAA GTGTTGTGTCGAGTGTCCTCCTTG TCCTGCTCCTCCTGTGGCAGGCC CATCTGTGTTTCTCTTTCCCCCAAA GCCAAAGGACACTTTGATGATATC CCGGACCCCTGAGGTGACTTGCG TCGTCGTAGATGTTTCACACGAAG ATCCAGAGGTGCAGTTCAACTGGT ACGTGGATGGCGTGGAAGTGCAT AATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2371 | EVQLVESGGGVVQPGR SLRLSCAASGFTFSSYA MHWVRQAPGKGLEWV AVISYDGSNKYYADSVK GRFTISRDNSKNTLYLQ MNSLRAEDTAVYYCAR SSPWGELSLYQGAFDI WGQGTMVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2479 | GAGGTGCAGCTGGTGGAGTCTGG GGGAGGCGTGGTCCAGCCTGGGA GGTCCCTGAGACTCTCCTGTGCAG CCTCTGGATTCACCTTCAGTAGCT ATGCTATGCACTGGGTCCGCCAG GCTCCAGGCAAGGGGCTGGAGTG GGTGGCAGTTATATCATATGATGG AAGTAATAAATACTACGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCCCGGTCGAGCCCCTGGG GGGAGTTATCGTTATACCAGGGG GCTTTTGATATCTGGGGCCAAGGG ACAATGGTCACCGTCTCTTCAGCA AGCACAAAAGGTCCTTCAGTGTTC CCTCTGGCACCTTGCTCACGCAGC ACCTCTGAGAGTACAGCCGCCCT GGGCTGCCTGGTAAAGGACTACTT TCCCGAACCAGTCACTGTGTCCTG GAATAGCGGGGCCTTGACCTCTG GAGTGCACACATTCCCAGCTGTAC TGCAGTCATCTGGACTCTACAGCC TGTCCAGTGTGGTCACCGTACCTT CCTCCAACTTTGGCACTCAAACAT ATACATGTAACGTGGATCATAAGC CCTCTAACACCAAAGTGGATAAAA CTGTGGAGCGTAAGTGTTGTGTCG AGTGTCCTCCTTGTCCTGCTCCTC CTGTGGCAGGCCCATCTGTGTTTC TCTTTCCCCCAAAGCCAAAGGACA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CTTTGATGATATCCCGGACCCCTG
AGGTGACTTGCGTCGTCGTAGATG
TTTCACACGAAGATCCAGAGGTGC
AGTTCAACTGGTACGTGGATGGCG
TGGAAGTGCATAATGCCAAGACAA
AGCCCCGCGAAGAGCAGTTTAATT
CCACCTTCCGCGTGGTGTCTGTGC
TGACCGTGGTACATCAGGATTGGC
TTAACGGTAAGGAGTACAAGTGCA
AGGTGAGTAACAAGGGGCTGCCC
GCCCCTATCGAGAAGACTATCAGT
AAAACCAAGGGCCAGCCAAGGGA
GCCACAGGTGTACACACTTCCACC
ATCTAGGGAGGAAATGACAAAGAA
CCAGGTGAGTTTGACCTGTCTCGT
GAAAGGCTTTTATCCCAGTGATAT
AGCCGTGGAATGGGAAAGTAACG
GGCAGCCCGAGAACAACTATAAGA
CCACACCACCCATGCTGGACTCC
GACGGTTCTTTCTTCCTTTATAGCA
AGCTGACAGTGGATAAATCCAGGT
GGCAGCAGGGTAACGTATTCAGTT
GCAGTGTCATGCACGAGGCACTC
CACAACCACTATACTCAGAAAAGT
CTTTCCCTGAGTCCAGGCAAG |
| SEQ ID 2372 | QITLKESGGGLVQPGRS
LRLSCAASGFTFDDYAM
HWVRQAPGKGLEWVS
AISGSGGSTYYADSVKG
RFTISRDNSKNTLYLQM
NSLRAEDTAVYYCAKDN
DFWSGKVFDYWGQGTL
VTVSSASTKGPSVFPLA
PCSRSTSESTAALGCLV
KDYFPEPVTVSWNSGA
LTSGVHTFPAVLQSSGL
YSLSSVVTVPSSNFGTQ
TYTCNVDHKPSNTKVDK
TVERKCCVECPPCPAP
PVAGPSVFLFPPKPKDT
LMISRTPEVTCVVVDVS
HEDPEVQFNWYVDGVE
VHNAKTKPREEQFNSTF
RVVSVLTVVHQDWLNG
KEYKCKVSNKGLPAPIE
KTISKTKGQPREPQVYT
LPPSREEMTKNQVSLTC
LVKGFYPSDIAVEWESN
GQPENNYKTTPPMLDS
DGSFFLYSKLTVDKSRW
QQGNVFSCSVMHEALH
NHYTQKSLSLSPGK | SEQ ID 2480 | CAGATCACCTTGAAGGAGTCTGGG
GGAGGCTTGGTACAGCCTGGCAG
GTCCCTGAGACTCTCCTGTGCAGC
CTCTGGATTCACCTTTGATGATTAT
GCCATGCACTGGGTCCGGCAAGC
TCCAGGGAAGGGGCTGGAGTGGG
TCTCAGCTATTAGTGGTAGTGGTG
GTAGCACATACTACGCAGACTCCG
TGAAGGGCCGGTTCACCATCTCCA
GAGACAATTCCAAGAACACGCTGT
ATCTGCAAATGAACAGCCTGAGAG
CCGAGGACACGGCCGTATATTACT
GTGCGAAAGATAACGATTTTTGGA
GTGGGAAAGTCTTTGACTACTGGG
GCCAGGGCACCCTGGTCACCGTC
TCCTCAGCAAGCACAAAAGGTCCT
TCAGTGTTCCCTCTGGCACCTTGC
TCACGCAGCACCTCTGAGAGTACA
GCCGCCCTGGGCTGCCTGGTAAA
GGACTACTTTCCCGAACCAGTCAC
TGTGTCCTGGAATAGCGGGGCCTT
GACCTCTGGAGTGCACACATTTCC
AGCTGTACTGCAGTCATCTGGACT
CTACAGCCTGTCCAGTGTGGTCAC
CGTACCTTCCTCCAACTTTGGCAC
TCAAACATATACATGTAACGTGGA
TCATAAGCCCTCTAACACCAAAGT
GGATAAAACTGTGGAGCGTAAGTG
TTGTGTCGAGTGTCCTCCTTGTCC
TGCTCCTCCTGTGGCAGGCCCATC
TGTGTTTCTCTTTCCCCCAAAGCC
AAAGGACACTTTGATGATATCCCG
GACCCCTGAGGTGACTTGCGTCG
TCGTAGATGTTTCACACGAAGATC
CAGAGGTGCAGTTCAACTGGTACG
TGGATGGCGTGGAAGTGCATAATG
CCAAGACAAAGCCCCGCGAAGAG
CAGTTTAATTCCACCTTCCGCGTG
GTGTCTGTGCTGACCGTGGTACAT
CAGGATTGGCTTAACGGTAAGGAG
TACAAGTGCAAGGTGAGTAACAAG
GGGCTGCCCGCCCCTATCGAGAA
GACTATCAGTAAAACCAAGGGCCA
GCCAAGGGAGCCACAGGTGTACA
CACTTCCACCATCTAGGGAGGAAA
TGACAAAGAACCAGGTGAGTTTGA
CCTGTCTCGTGAAAGGCTTTTATC
CCAGTGATATAGCCGTGGAATGG
GAAAGTAACGGGCAGCCCGAGAA
CAACTATAAGACCACACCACCCAT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GCTGGACTCCGACGGTTCTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAGTCTTTCCCTGAGTCC AGGCAAG |
| SEQ ID 2373 | EVQLVQSGGGLVQPGG SLRLSCAASGFTFSSYS MNWRQAPGKGLEWV SYISSTSSTIYYADSVKG RFTISRDNSKNMLFLQM NSLRAEDTAVYYCAKEG GSGWRHYFDYWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2481 | GAAGTGCAGCTGGTGCAGTCTGG GGGAGGCTTGGTACAGCCTGGGG GGTCCCTGAGACTCTCCTGTGCAG CCTCTGGATTCACCTTCAGTAGTT ATAGCATGAACTGGGTCCGCCAG GCTCCAGGGAAGGGGCTGGAGTG GGTTTCATACATCAGTAGTACTAG TAGTACCATATACTACGCAGACTC CGTGAAGGGCCGATTCACCATCTC CAGAGACAATTCCAAGAATATGCT GTTTCTACAAATGAACAGCCTGAG AGCTGAGGACACGGCTGTGTATTA CTGTGCGAAAGAAGGGGGCAGTG GCTGGCGCCACTACTTTGACTACT GGGGCCAGGGAACCCTGGTCACC GTCTCCTCAGCAAGCACAAAAGGT CCTTCAGTGTTCCCTCTGGCACCT TGCTCACGCAGCACCTCTGAGAGT ACAGCCGCCCTGGGCTGCCTGGT AAAGGACTACTTTCCCGAACCAGT CACTGTGTCCTGGAATAGCGGGG CCTTGACCTCTGGAGTGCACACAT TTCCAGCTGTACTGCAGTCATCTG GACTCTACAGCCTGTCCAGTGTGG TCACCGTACCTTCCTCCAACTTTG GCACTCAAACATATACATGTAACG TGGATCATAAGCCCTCTAACACCA AAGTGGATAAAACTGTGGAGCGTA AGTGTTGTGTCGAGTGTCCTCCTT GTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAGTCTTTCCCT GAGTCCAGGCAAG |
| SEQ ID 2374 | QVTLKESGGGVVQPGR SLRLSCAASGFTFSSYA MHWVRQAPGKGLEWV AVISYDGSNKYYADSVK GRFTISRDNSKNTLYLQ MNSLRAEDTAVYYCAR DYCSSTSCQNWFDPW GQGTLVTVSSASTKGPS VFPLAPCSRSTSESTAA LGCLVKDYFPEPVTVSW | SEQ ID 2482 | CAGGTCACCTTGAAGGAGTCTGG GGGAGGCGTGGTCCAGCCTGGGA GGTCCCTGAGACTGTCCTGTGCA GCCTCTGGATTCACCTTCAGCAGC TATGCTATGCACTGGGTCCGCCAG GCTCCAGGCAAGGGGCTGGAGTG GGTGGCAGTTATATCATATGATGG AAGTAATAAATACTACGCAGACTC CGTGAAGGGCCGATTCACCATCTC CAGAGACAATTCCAAGAACACGCT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | GTATCTGCAAATGAACAGCCTGAG AGCTGAGGACACGGCTGTGTATTA CTGTGCGAGAGATTATTGTAGTAG TACCAGCTGCCAGAACTGGTTCGA CCCCTGGGGCCAGGGCACCCTGG TCACCGTCTCCTCAGCAAGCACAA AAGGTCCTTCAGTGTTCCCTCTGG CACCTTGCTCACGCAGCACCTCTG AGAGTACAGCCGCCCTGGGCTGC CTGGTAAAGGACTACTTTCCCGAA CCAGTCACTGTGTCCTGGAATAGC GGGGCCTTGACCTCTGGAGTGCA CACATTTCCAGCTGTACTGCAGTC ATCTGGACTCTACAGCCTGTCCAG TGTGGTCACCGTACCTTCCTCCAA CTTTGGCACTCAAACATATACATGT AACGTGGATCATAAGCCCTCTAAC ACCAAAGTGGATAAAACTGTGGAG CGTAAGTGTTGTGTCGAGTGTCCT CCTTGTCCTGCTCCTCCTGTGGCA GGCCCATCTGTGTTTCTCTTTCCC CCAAAGCCAAAGGACACTTTGATG ATATCCCGGACCCCTGAGGTGACT TGCGTCGTCGTAGATGTTTCACAC GAAGATCCAGAGGTGCAGTTCAAC TGGTACGTGGATGGCGTGGAAGT GCATAATGCCAAGACAAAGCCCCG CGAAGAGCAGTTTAATTCCACCTT CCGCGTGGTCTGTGCTGACCG TGGTACATCAGGATTGGCTTAACG GTAAGGAGTACAAGTGCAAGGTGA GTAACAAGGGGCTGCCCGCCCCT ATCGAGAAGACTATCAGTAAAACC AAGGGCCAGCCAAGGGAGCCACA GGTGTACACACTTCCACCATCTAG GGAGGAAATGACAAAGAACCAGG TGAGTTTGACCTGTCTCGTGAAAG GCTTTTATCCCAGTGATATAGCCG TGGAATGGGAAAGTAACGGGCAG CCCGAGAACAACTATAAGACCACA CCACCCATGCTGGACTCCGACGG TTCTTTCTTCCTTTATAGCAAGCTG ACAGTGGATAAATCCAGGTGGCAG CAGGGTAACGTATTCAGTTGCAGT GTCATGCACGAGGCACTCCACAAC CACTATACTCAGAAAAGTCTTTCC CTGAGTCCAGGCAAG |
| SEQ ID 2375 | QVQLVQSGGGLVQPGG SLRLSCAASGFTFSNYV MSWVRQAPGKGLEWV SAISGIGDTTYYADSVK GRFTISRDNAKNTLYLQ MNSLRAEDTAVYYCAR GRVAGDAFDIWGQGTM VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | SEQ ID 2483 | CAGGTCCAGCTGGTGCAGTCTGG GGGAGGCTTGGTACAGCCTGGGG GGTCCCTGAGACTCTCCTGTGCAG CCTCTGGATTCACCTTTAGCAACT ATGTCATGAGCTGGGTCCGCCAG GCTCCAGGGAAGGGGCTGGAGTG GGTCTCAGCTATTAGTGGTATTGG TGATACTACATACTACGCGGACTC CGTGAAGGGCCGATTCACCATCTC CAGAGACAACGCCAAGAACACGC TGTATCTGCAAATGAACAGTCTGA GAGCCGAGGACACGGCTGTGTAT TACTGTGCAAGAGGGCGCGTGGC GGGGGATGCTTTTGATATCTGGGG CCAAGGGACAATGGTGACCGTCT CTTCAGCAAGCACAAAAGGTCCTT CAGTGTTCCCTCTGGCACCTTGCT CACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TTGTGTCGAGTGTCCTCCTTGTCC
TGCTCCTCCTGTGGCAGGCCCATC
TGTGTTTCTCTTTCCCCCAAAGCC
AAAGGACACTTTGATGATATCCCG
GACCCCTGAGGTGACTTGCGTCG
TCGTAGATGTTTCACACGAAGATC
CAGAGGTGCAGTTCAACTGGTACG
TGGATGGCGTGGAAGTGCATAATG
CCAAGACAAAGCCCCGCGAAGAG
CAGTTTAATTCCACCTTCCGCGTG
GTGTCTGTGCTGACCGTGGTACAT
CAGGATTGGCTTAACGGTAAGGAG
TACAAGTGCAAGGTGAGTAACAAG
GGGCTGCCCGCCCCTATCGAGAA
GACTATCAGTAAAACCAAGGGCCA
GCCAAGGGAGCCACAGGTGTACA
CACTTCCACCATCTAGGGAGGAAA
TGACAAGAACCAGGTGAGTTTGA
CCTGTCTCGTGAAAGGCTTTTATC
CCAGTGATATAGCCGTGGAATGG
GAAAGTAACGGGCAGCCCGAGAA
CAACTATAAGACCACACCACCCAT
GCTGGACTCCGACGGTTCTTTCTT
CCTTTTATAGCAAGCTGACAGTGGA
TAAATCCAGGTGGCAGCAGGGTAA
CGTATTCAGTTGCAGTGTCATGCA
CGAGGCACTCCACAACCACTATAC
TCAGAAAAGTCTTTCCCTGAGTCC
AGGCAAG |
| SEQ ID 2376 | QLQLQESGGGLVQPGG
SLRLSCAASGFTFSSYA
MSWVRQAPGKGLEWV
SAISGSGGSTYYADSVK
GRFTISRDNSKNTLYLQ
MNSLRAEDTAVYYCAK
DQGAAAGTLGYFDYWG
QGTLVTVSSASTKGPSV
FPLAPCSRSTSESTAAL
GCLVKDYFPEPVTVSW
NSGALTSGVHTFPAVLQ
SSGLYSLSSVVTVPSSN
FGTQTYTCNVDHKPSN
TKVDKTVERKCCVECPP
CPAPPVAGPSVFLFPPK
PKDTLMISRTPEVTCVV
VDVSHEDPEVQFNWYV
DGVEVHNAKTKPREEQ
FNSTFRVVSVLTVVHQD
WLNGKEYKCKVSNKGL
PAPIEKTISKTKGQPREP
QVYTLPPSREEMTKNQ
VSLTCLVKGFYPSDIAVE
WESNGQPENNYKTTPP
MLDSDGSFFLYSKLTVD
KSRWQQGNVFSCSVM
HEALHNHYTQKSLSLSP
GK | SEQ ID 2484 | CAGCTGCAGCTGCAGGAGTCGGG
GGGAGGCTTGGTACAGCCTGGGG
GGTCCCTGAGACTCTCCTGTGCAG
CCTCTGGATTCACCTTTAGCAGCT
ATGCCATGAGCTGGGTCCGCCAG
GCTCCAGGGAAGGGGCTGGAGTG
GGTCTCAGCTATTAGTGGTAGTGG
TGGTAGCACATACTACGCAGACTC
CGTGAAGGGCCGGTTCACCATCT
CCAGAGACAATTCCAAGAACACGC
TGTATCTGCAAATGAACAGCCTGA
GAGCCGAGGACACGGCCGTATAT
TACTGTGCGAAAGATCAAGGGGCA
GCAGCTGGTACCCTGGGGTACTTT
GACTACTGGGGCCAGGGAACCCT
GGTGACCGTCTCCTCAGCAAGCA
CAAAAGGTCCTTCAGTGTTCCCTC
TGGCACCTTGCTCACGCAGCACCT
CTGAGAGTACAGCCGCCCTGGGC
TGCCTGGTAAAGGACTACTTTCCC
GAACCAGTCACTGTGTCCTGGAAT
AGCGGGGCCTTGACCTCTGGAGT
GCACACATTTCCAGCTGTACTGCA
GTCATCTGGACTCTACAGCCTCAG
CAGTGTGGTCACCGTACCTTCCTC
AACTTTGGCACTCAAACATATAC
ATGTAACGTGGATCATAAGCCCTC
TAACACCAAAGTGGATAAAACTGT
GGAGCGTAAGTGTTGTGTCGAGT
GTCCTCCTTGTCCTGCTCCTCCTG
TGGCAGGCCCATCTGTGTTTCTCT
TTCCCCCAAAGCCAAAGGACACTT
TGATGATATCCCGGACCCCTGAGG
TGACTTGCGTCGTCGTAGATGTTT
CACACGAAGATCCAGAGGTGCAG
TTCAACTGGTACGTGGATGGCGTG
GAAGTGCATAATGCCAAGACAAAG
CCCCGCGAAGAGCAGTTTAATTCC
ACCTTCCGCGTGGTGTCTGTGCTG
ACCGTGGTACATCAGGATTGGCTT
AACGGTAAGGAGTACAAGTGCAAG
GTGAGTAACAAGGGGCTGCCCGC
CCCTATCGAGAAGACTATCAGTAA
AACCAAGGGCCAGCCAAGGGAGC
CACAGGTGTACACACTTCCACCAT
CTAGGGAGGAAATGACAAAGAACC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2377 | QVQLVQSGAEVKKPGA SVKVSCKASGYTFTSYD INWRQATGQGLEWMG WMNPNSGNTGYAQKF QGRVTMTRNTSISTAYM ELSSLRSEDTAVYYCTR GIYDSSGSSNPFDSWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2485 | CAGGTGCAGCTGGTGCAGTCTGG GGCTGAGGTGAAGAAGCCTGGGG CCTCAGTGAAGGTCTCCTGCAAGG CTTCTGGATACACCTTCACCAGTT ATGATATCAACTGGTGCGCACAGG CCACTGGACAAGGGCTTGAGTGG ATGGGATGGATGAACCCTAACAGT GGTAACACAGGCTATGCACAGAAG TTCCAGGGCAGAGTCACCATGACC AGGAACACCTCCATAAGCACAGCC TACATGGAGCTGAGCAGCCTGAG ATCTGAGGACACGGCCGTGTATTA CTGTACGAGAGGAATCTATGATAG TAGTGGTTCTTCCAATCCCTTTGA CTCCTGGGGCCAGGGAACCCTGG TGACCGTCTCCTCAGCAAGCACAA AAGGTCCTTCAGTGTTCCCTCTGG CACCTTGCTCACGCAGCACCTCTG AGAGTACAGCCGCCCTGGGCTGC CTGGTAAAGGACTACTTTCCCGAA CCAGTCACTGTGTCCTGGAATAGC GGGGCCTTGACCTCTGGAGTGCA CACATTTCCAGCTGTACTGCAGTC ATCTGGACTCTACAGCCTGTCCAG TGTGGTCACCGTACCTTCCTCCAA CTTTGGCACTCAAACATATACATGT AACGTGGATCATAAGCCCTCTAAC ACCAAAGTGGATAAAACTGTGGAG CGTAAGTGTTGTGTCGAGTGTCCT CCTTGTCCTGCTCCTCCTGTGGCA GGCCCATCTGTGTTTCTCTTTCCC CCAAAGCCAAAGGACACTTTGATG ATATCCCGGACCCCTGAGGTGACT TGCGTCGTCGTAGATGTTTCACAC GAAGATCCAGAGGTGCAGTTCAAC TGGTACGTGGATGGCGTGGAAGT GCATAATGCCAAGACAAAGCCCCG CGAAGAGCAGTTTAATTCCACCTT CCGCGTGGTGTCTGTGCTGACCG TGGTACATCAGGATTGGCTTAACG GTAAGGAGTACAAGTGCAAGGTGA GTAACAAGGGGCTGCCCGCCCCT ATCGAGAAGACTATCAGTAAAACC AAGGGCCAGCCAAGGGAGCCACA GGTGTACACACTTCCACCATCTAG GGAGGAAATGACAAAGAACCAGG TGAGTTTGACCTGTCTCGTGAAAG GCTTTTATCCCAGTGATATAGCCG TGGAATGGGAAAGTAACGGGCAG CCCGAGAACAACTATAAGACCACA CCACCCATGCTGGACTCCGACGG TTCTTTCTTCCTTTATAGCAAGCTG ACAGTGGATAAATCCAGGTGGCAG CAGGGTAACGTATTCAGTTGCAGT GTCATGCACGAGGCACTCCACAAC CACTATACTCAGAAAAGTCTTTCC CTGAGTCCAGGCAAG |
| SEQ ID 2378 | EVQLVQSGAEVKKPGA SVKISCEASGYTFTDYAI HWRQAPGQRLEWMG WINAGDGGTKSSREFQ GRVTITRDTSATTAYME VSSLRSEDTAVYYCARG | SEQ ID 2486 | GAGGTGCAGCTGGTGCAGTCTGG GGCTGAGGTGAAGAAGCCTGGGG CCTCAGTGAAGATTTCCTGCGAGG CTTCTGGATACACCTTCACTGATTA TGCTATACATTGGGTGCGCCAGGC CCCCGGACAAAGACTTGAGTGGAT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | YCSGGSCPGTDFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | GGGATGGATCAACGCTGGCGATG GTGGCACAAAAGTTCACGGGAGT TCCAGGGCAGAGTCACCATTACCA GGGACACATCCGCGACCACACC TACATGGAGGTGAGCAGTCTGAGA TCTGAAGACACGGCTGTCTATTAC TGTGCGAGAGGATATTGTAGTGGT GGTAGCTGCCCAGGAACGGATTTT GACTACTGGGGCCAGGGAACCCT GGTCACCGTCTCCTCAGCAAGCAC AAAAGGTCCTTCAGTGTTCCTCT GGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2379 | QVQLVQSGAEVKKPGA SVKVSCKASGYTFTSYY MHWVRQAPGQGLEWM GIINPSGGSTSYAQKFQ GRVTMTRDTSTSTVYM ELSSLRSEDTAVYYCAR DGVGGRDGYNFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP | SEQ ID 2487 | CAGGTGCAGCTGGTGCAGTCTGG GGCTGAGGTGAAGAAGCCTGGGG CCTCAGTGAAGGTTTCCTGCAAGG CATCTGGATACACCTTCACCAGCT ACTATATGCACTGGGTGCGACAGG CCCCTGGACAAGGGCTTGAGTGG ATGGGAATAATCAACCCTAGTGGT GGTAGCACAAGCTACGCACAGAA GTTCCAGGGCAGAGTCACCATGA CCAGGGACACGTCCACGAGCACA GTCTACATGGAGCTGAGCAGCCT GAGATCTGAGGACACGGCCGTGT ATTACTGTGCGAGAGATGGTGTAG GAGGGAGAGATGGCTACAATTTTG ACTACTGGGGCCAGGGAACCCTG GTCACCGTCTCCTCAGCAAGCACA AAAGGTCCTTCAGTGTTCCCTCTG GCACCTTGCTCACGCAGCACCTCT GAGAGTACAGCCGCCCTGGGCTG CCTGGTAAAGGACTACTTTCCCGA ACCAGTCACTGTGTCCTGGAATAG CGGGGCCTTGACCTCTGGAGTGC ACACATTTCCAGCTGTACTGCAGT CATCTGGACTCTACAGCCTGTCCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | MLDSDGSFFLYSKLTVD KSRWQQGNVFSCSVM HEALHNHYTQKSLSLSP GK | | GTGTGGTCACCGTACCTTCCTCCA ACTTTGGCACTCAAACATATACAT GTAACGTGGATCATAAGCCCTCTA ACACCAAAGTGGATAAAACTGTGG AGCGTAAGTGTTGTGTCGAGTGTC CTCCTTGTCCTGCTCCTCCTGTGG CAGGCCCATCTGTGTTTCTCTTTC CCCCAAAGCCAAAGGACACTTTGA TGATATCCCGGACCCCTGAGGTGA CTTGCGTCGTCGTAGATGTTTCAC ACGAAGATCCAGAGGTGCAGTTCA ACTGGTACGTGGATGGCGTGGAA GTGCATAATGCCAAGACAAAGCCC CGCGAAGAGCAGTTTAATTCCACC TTCCGCGTGGTGTCTGTGCTGACC GTGGTACATCAGGATTGGCTTAAC GGTAAGGAGTACAAGTGCAAGGT GAGTAACAAGGGGCTGCCCGCCC CTATCGAGAAGACTATCAGTAAAA CCAAGGGCCAGCCAAGGGAGCCA CAGGTGTACACACTTCCACCATCT AGGGAGGAAATGACAAAGAACCA GGTGAGTTTGACCTGTCTCGTGAA AGGCTTTTATCCCAGTGATATAGC CGTGGAATGGGAAAGTAACGGGC AGCCCGAGAACAACTATAAGACCA CACCACCCATGCTGGACTCCGAC GGTTCTTTCTTCCTTTATAGCAAGC TGACAGTGGATAAATCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2380 | EVQLVQSGGGLVQPGG SLRLSCAASGFTVSSNY MSWRQAPGKGLEWV SVIYSGGSTYYADSVKG RFTISRDNSKNTLYLQM NSLRAEDTAVYYCARAP LAADGYFDYWGQGTLV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2488 | GAAGTGCAGCTGGTGCAGTCTGG GGGAGGCTTGGTCCAGCCTGGGG GGTCCCTGAGACTCTCCTGTGCAG CCTCTGGATTCACCGTCAGTAGCA ACTACATGAGCTGGGTCCGCCAG GCTCCAGGGAAGGGGCTGGAGTG GGTCTCAGTTATTTATAGCGGTGG TAGCACATACTACGCAGACTCCGT GAAGGGCCGATTCACCATCTCCAG AGACAATTCCAAGAACACGCTGTA TCTTCAAATGAACAGCCTGAGAGC TGAGGACACGGCTGTGTATTACTG TGCGAGAGCCCCCCTAGCAGCAG ATGGCTACTTTGACTACTGGGGCC AGGGAACCCTGGTCACCGTCTCCT CAGCAAGCACAAAAGGTCCTTCAG TGTTCCCTCTGGCACCTTGCTCAC GCAGCACCTCTGAGAGTACAGCC GCCCTGGGCTGCCTGGTAAAGGA CTACTTTCCCGAACCAGTCACTGT GTCCTGGAATAGCGGGGCCTTGA CCTCTGGAGTGCACACATTTCCAG CTGTACTGCAGTCATCTGGACTCT ACAGCCTGTCCAGTGTGGTCACC GTACCTTCCTCCAACTTTGGCACT CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG TGTCTGTGCTGACCGTGGTACATC AGGATTGGCTTAACGGTAAGGAGT ACAAGTGCAAGGTGAGTAACAAGG GGCTGCCCGCCCCTATCGAGAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | ACTATCAGTAAAACCAAGGGCCAG CCAAGGGAGCCACAGGTGTACAC ACTTCCACCATCTAGGGAGGAAAT GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2381 | EVQLVQSGAEVKKPGS SVKVSCKASGGTFSSYA ISWVRQAPGQGLEWMG GIIPIFGTANYAQKFQGR VTITADESTSTAYMELSS LRSEDTAVYYCARARGL QYLIWYFDLWGRGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2489 | GAGGTCCAGCTGGTGCAGTCTGG GGCTGAGGTGAAGAAGCCTGGGT CCTCGGTGAAGGTCTCCTGCAAG GCTTCTGGAGGCACCTTCAGCAG CTATGCTATCAGCTGGGTGCGACA GGCCCCTGGACAAGGGCTTGAGT GGATGGGAGGGATCATCCCTATCT TTGGTACAGCAAACTACGCACAGA AGTTCCAGGGCAGAGTCACGATTA CCGCGGACGAATCCACGAGCACA GCCTACATGGAGCTGAGCAGCCT GAGATCTGAGGACACGGCCGTGT ATTACTGTGCGAGAGCCCGGGGG CTACAGTACCTAATCTGGTACTTC GATCTCTGGGGCCGTGGCACCCT GGTGACCGTCTCCTCAGCAAGCA CAAAAGGTCCTTCAGTGTTCCCTC TGGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2382 | QVQLVQSGAEVKKPGA SVKVSCKASGYTFTSYY MHWVRQAPGQGLEWM GIINPSGGSTSYAQKFQ GRVTMTRDTSTSTVYM ELSSLRSEDTAVYYCAS PGMVRGVITAPLDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2490 | CAGGTCCAGCTGGTACAGTCTGG GGCTGAGGTGAAGAAGCCTGGGG CCTCAGTGAAGGTTTCCTGCAAGG CATCTGGATACACCTTCACCAGCT ACTATATGCACTGGGTGCGACAGG CCCCTGGACAAGGGCTTGAGTGG ATGGGAATAATCAACCCTAGTGGT GGTAGCACAAGCTACGCACAGAA GTTCCAGGGCAGAGTCACCATGA CCAGGGACACGTCCACGAGCACA GTCTACATGGAGCTGAGCAGCCT GAGATCTGAGGACACGGCCGTGT ATTACTGTGCGAGCCCGGGTATG GTTCGGGGAGTTATTACTGCCCCG CTTGACTACTGGGGCCAGGGCAC CCTGGTCACCGTCTCCTCAGCAAG CACAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2383 | EVQLVQSGGGLVKPGG SLRLSCAASGFTFSSYAI SWRQAPGQGLEWMG GIIPMYGTANYAQKFQG RVTITADESTSTAYMEL SSLRSEDTALYYCAREA KWGMYYFDYWGQGTL VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF | SEQ ID 2491 | GAGGTCCAGCTGGTACAGTCTGG GGGAGGCCTGGTCAAGCCTGGGG GGTCCCTGAGACTCTCCTGTGCAG CCTCTGGATTCACCTTCAGCAGCT ATGCTATCAGCTGGGTGCGACAG GCCCCTGGACAAGGGCTTGAGTG GATGGGAGGGATCATCCCTATGTA TGGTACAGCAAACTACGCACAGAA GTTCCAGGGCAGAGTCACGATTAC CGCGGACGAATCCACGAGCACAG CCTACATGAACTGAGCAGCCTGA GATCTGAGGACACGGCCCTCTATT ACTGTGCGAGAGAAGCTAAGTGG GGAATGTACTACTTTGACTACTGG GGCCAGGGCACCCTGGTCACCGT CTCCTCAGCAAGCACAAAGGTCC TTCAGTGTTCCCTCTGGCACCTTG CTCACGCAGCACCTCTGAGAGTAC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | | AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2384 | EVQLVESGGGVVQPGR SLRLSCAASGFTFSSYAI HWVRQAPGKGLEWVAII SDDGSKSYYADSVQGR FTISRDNSRNTVYLQMN SLRAEDTAMYYCARDR GTKWNQLNDVFDMWG QGTMVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2492 | GAGGTGCAGCTGGTGGAGTCCGG GGGAGGCGTGGTCCAGCCTGGGA GGTCCCTGAGACTCTCCTGTGCAG CCTCTGGATTCACCTTCAGTAGCT ATGCTATACACTGGGTCCGCCAGG CTCCAGGCAAGGGGCTGGAGTGG GTGGCAATTATATCAGATGATGGA AGTAAGAGTTACTACGCAGACTCC GTGCAGGGCCGATTCACCATCTCC AGAGACAATTCGAGGAACACAGTA TATCTGCAAATGAACAGCCTGAGA GCTGAGGACACGGCTATGTATTAC TGTGCGAGAGACAGGGGAACTAA ATGGAACCAATTGAATGATGTTTTT GATATGTGGGGCCAAGGGACAAT GGTCACCGTCTCTTCAGCAAGCAC AAAAGGTCCTTCAGTGTTCCCTCT GGCACCTTGCTCGCCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2385 | QMQLVQSGAEVKKPGA SVKVSCTASGYTFTSSD INWVRQATGQGLEWMG WMNPNSGNTGYAEKFQ GRVTMTSDSSISTAYME LRSLTTEDTAVYYCARG GGASYTDSWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2493 | CAGATGCAGCTGGTGCAATCTGG GGCTGAGGTGAAGAAGCCTGGGG CCTCAGTGAAGGTCTCCTGCACG GCTTCTGGATACACCTTCACCAGT TCTGATATCAACTGGGTGCGACAG GCCACTGGACAAGGGCTTGAGTG GATGGGATGGATGAACCCTAACAG TGGTAACACCGGCTATGCAGAGAA GTTCCAGGGCAGGGTCACCATGA CCAGCGACTCCTCCATAAGCACCG CCTACATGGAGTTGAGAAGCCTGA CCACTGAGGACACGGCCGTATATT ACTGTGCGAGAGGTGGGGGTGCG AGCTATACTGACTCCTGGGGCCAG GGCACCCTGGTCACCGTCTCCTCA GCAAGCACAAAAGGTCCTTCAGTG TTCCCTCTGGCACCTTGCTCACGC AGCACCTCTGAGAGTACAGCCGC CCTGGGCTGCCTGGTAAAGGACT ACTTTCCCGAACCAGTCACTGTGT CCTGGAATAGCGGGGCCTTGACC TCTGGAGTGCACACATTTCCAGCT GTACTGCAGTCATCTGGACTCTAC AGCCTGTCCAGTGTGGTCACCGTA CCTTCCTCCAACTTTGGCACTCAA ACATATACATGTAACGTGGATCAT AAGCCCTCTAACACCAAAGTGGAT AAAACTGTGGAGCGTAAGTGTTGT GTCGAGTGTCCTCCTTGTCCTGCT CCTCCTGTGGCAGGCCCATCTGT GTTTCTCTTTCCCCCAAAGCCAAA GGACACTTTGATGATATCCCGGAC CCCTGAGGTGACTTGCGTCGTCGT AGATGTTTCACACGAAGATCCAGA GGTGCAGTTCAACTGGTACGTGGA TGGCGTGGAAGTGCATAATGCCAA GACAAAGCCCCGCGAAGAGCAGT TTAATTCCACCTTCCGCGTGGTGT CTGTGCTGACCGTGGTACATCAGG ATTGGCTTAACGGTAAGGAGTACA AGTGCAAGGTGAGTAACAAGGGG CTGCCCGCCCCTATCGAGAAGACT ATCAGTAAAACCAAGGGCCAGCCA AGGGAGCCACAGGTGTACACACTT CCACCATCTAGGGAGGAAATGACA AAGAACCAGGTGAGTTTGACCTGT CTCGTGAAAGGCTTTTATCCCAGT GATATAGCCGTGGAATGGGAAAGT AACGGGCAGCCCGAGAACAACTA TAAGACCACACCACCCATGCTGGA CTCCGACGGTTCTTTCTTCCTTTAT AGCAAGCTGACAGTGGATAAATCC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGGTGGCAGCAGGGTAACGTATT CAGTTGCAGTGTCATGCACGAGG CACTCCACAACCACTATACTCAGA AAAGTCTTTCCCTGAGTCCAGGCA AG |
| SEQ ID 2386 | QVQLVQSGGGLVQPGR SLRLSCTASGFTFGDYA MSWFRQAPGKGLEWV GFIRSKAYGGTTEYAAS VKGRFTISRDDSKSIAYL QMNSLKTEDTAVYYCTA KGGYVGYSYGPFGGY WGQGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2494 | CAGGTCCAGCTGGTGCAGTCTGG GGGAGGCTTGGTACAGCCAGGGC GGTCCCTGAGACTCTCCTGTACAG CTTCTGGATTCACCTTTGGTGATTA TGCTATGAGCTGGTTCCGCCAGG CTCCAGGGAAGGGGCTGGAGTGG GTAGGTTTCATTAGAAGCAAAGCT TATGGTGGGACAACAGAATACGCC GCGTCTGTGAAAGGCAGATTCACC ATCTCAAGAGATGATTCCAAAAGC ATCGCCTATCTGCAAATGAACAGC CTGAAAACCGAGGACACAGCCGT GTATTACTGTACCGCTAAGGGGGG CTACGTCGGATACAGCTATGGACC TTTTGGGGGCTACTGGGGCCAGG GAACCCTGGTCACCGTCTCCTCAG CAAGCACAAAAGGTCCTTCAGTGT TCCCTCTGGCACCTTGCTCACGCA GCACCTCTGAGAGTACAGCCGCC CTGGGCTGCCTGGTAAAGGACTA CTTTCCCGAACCAGTCACTGTGTC CTGGAATAGCGGGGCCTTGACCT CTGGAGTGCACACATTTCCAGCTG TACTGCAGTCATCTGGACTCTACA GCCTGTCCAGTGTGGTCACCGTAC CTTCCTCCAACTTTGGCACTCAAA CATATACATGTAACGTGGATCATA AGCCCTCTAACACCAAAGTGGATA AAACTGTGGAGCGTAAGTGTTGTG TCGAGTGTCCTCCTTGTCCTGCTC CTCCTGTGGCAGGCCCATCTGTGT TTCTCTTTCCCCCAAAGCCAAAGG ACACTTTGATGATATCCCGGACCC CTGAGGTGACTTGCGTCGTCGTAG ATGTTTCACACGAAGATCCAGAGG TGCAGTTCAACTGGTACGTGGATG GCGTGGAAGTGCATAATGCCAAGA CAAAGCCCCGCGAAGAGCAGTTTA ATTCCACCTTCCGCGTGGTGTCTG TGCTGACCGTGGTACATCAGGATT GGCTTAACGGTAAGGAGTACAAGT GCAAGGTGAGTAACAAGGGGCTG CCCGCCCCTATCGAGAAGACTATC AGTAAAACCAAGGGCCAGCCAAG GGAGCCACAGGTGTACACACTTCC ACCATCTAGGGAGGAAATGACAAA GAACCAGGTGAGTTTGACCTGTCT CGTGAAAGGCTTTTATCCCAGTGA TATAGCCGTGGAATGGGAAAGTAA CGGGCAGCCCGAGAACAACTATA AGACCACACCACCCATGCTGGACT CCGACGGTTCTTTCTTCCTTTATAG CAAGCTGACAGTGGATAAATCCAG GTGGCAGCAGGGTAACGTATTCA GTTGCAGTGTCATGCACGAGGCA CTCCACAACCACTATACTCAGAAA AGTCTTTCCCTGAGTCCAGGCAAG |
| SEQ ID 2387 | QVQLVQSGGGLVQPGR SLRLSCTASGFTFGDYA MSWFRQAPGKGLEWV GFIRSKAYGGTTEYAAS VKGRFTISRDDSKSIAYL QMNSLKTEDTAVYYCT RGGTMVRGFGFNYWG QGTLVTVSSASTKGPSV FPLAPCSRSTSESTAAL GCLVKDYFPEPVTVSW NSGALTSGVHTFPAVLQ SSGLYSLSSVVTVPSSN | SEQ ID 2495 | CAGGTGCAGCTGGTGCAGTCTGG GGGAGGCTTGGTACAGCCAGGGC GGTCCCTGAGACTCTCCTGTACAG CTTCTGGATTCACCTTTGGTGATTA TGCTATGAGCTGGTTCCGCCAGG CTCCAGGGAAGGGGCTGGAGTGG GTAGGTTTCATTAGAAGCAAAGCT TATGGTGGGACAACAGAATACGCC GCGTCTGTGAAAGGCAGATTCACC ATCTCAAGAGATGATTCCAAAAGC ATCGCCTATCTGCAAATGAACAGC CTGAAAACCGAGGACACAGCCGT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | GTATTACTGTACTAGAGGGGGAC TATGGTTCGGGGTTTCGGATTTAA CTACTGGGGCCAGGGAACCCTGG TCACCGTCTCCTCAGCAAGCACA AAGGTCCTTCAGTGTTCCCTCTGG CACCTTGCTCACGCAGCACCTCTG AGAGTACAGCCGCCCTGGGCTGC CTGGTAAAGGACTACTTTCCCGAA CCAGTCACTGTGTCCTGGAATAGC GGGGCCTTGACCTCTGGAGTGCA CACATTTCCAGCTGTACTGCAGTC ATCTGGACTCTACAGCCTGTCCAG TGTGGTCACCGTACCTTCCTCCAA CTTTGGCACTCAAACATATACATGT AACGTGGATCATAAGCCCTCTAAC ACCAAAGTGGATAAAACTGTGGAG CGTAAGTGTTGTGTCGAGTGTCCT CCTTGTCCTGCTCCTCCTGTGGCA GGCCCCATCTGTGTTTCTCTTTCCC CCAAAGCCAAAGGACACTTTGATG ATATCCCGGACCCCTGAGGTGACT TGCGTCGTCGTAGATGTTTCACAC GAAGATCCAGAGGTGCAGTTCAAC TGGTACGTGGATGGCGTGGAAGT GCATAATGCCAAGACAAAGCCCCG CGAAGAGCAGTTTAATTCCACCTT CCGCGTGGTGTCTGTGCTGACCG TGGTACATCAGGATTGGCTTAACG GTAAGGAGTACAAGTGCAAGGTGA GTAACAAGGGGCTGCCCGCCCCT ATCGAGAAGACTATCAGTAAAACC AAGGGCCAGCCAAGGGAGCCACA GGTGTACACACTTCCACCATCTAG GGAGGAAATGACAAAGAACCAGG TGAGTTTGACCTGTCTCGTGAAAG GCTTTTATCCCAGTGATATAGCCG TGGAATGGGAAAGTAACGGGCAG CCCGAGAACAACTATAAGACCACA CCACCCATGCTGGACTCCGACGG TTCTTTCTTCCTTTATAGCAAGCTG ACAGTGGATAAATCCAGGTGGCAG CAGGGTAACGTATTCAGTTGCAGT GTCATGCACGAGGCACTCCACAAC CACTATACTCAGAAAAGTCTTTCC CTGAGTCCAGGCAAG |
| SEQ ID 2388 | QVQLQQWGAGLLKPSE TLSLTCAVYGGSFSGYY WSWIRQPPGKGLEWIG EINHSGSTNYNPSLKSR VTISVDTSKNQFSLKLSS VTAADTAVYYCARARRA MIGPLPRLVGYFDLWGR GTLVTVSSASTKGPSVF PLAPCSRSTSESTAALG CLVKDYFPEPVTVSWN SGALTSGVHTFPAVLQS SGLYSLSSVVTVPSSNF GTQTYTCNVDHKPSNT KVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2496 | CAGGTGCAGCTACAGCAGTGGGG CGCAGGACTGTTGAAGCCTTCGG AGACCCTGTCCCTCACCTGCGCTG TCTATGGTGGGTCCTTCAGTGGTT ACTACTGGAGCTGGATCCGCCAG CCCCCAGGGAAGGGGCTGGAGTG GATTGGGGAAATCAATCATAGTGG AAGCACCAACTACAACCCGTCCTT CAAGAGTCGAGTCACCATATCAGT AGACACGTCCAAGAACCAGTTCTC CCTGAAGCTGAGCTCTGTGACCG CCGCGGACACGGCTGTGTATTACT GTGCGAGAGCCCGGCGGCTATG ATAGGGCCGCTTCCGCGACTTGTC GGGTACTTCGATCTCTGGGGCCG TGGAACCCTGGTCACCGTCTCCTC AGCAAGCACAAAAGGTCCTTCAGT GTTCCCTCTGGCACCTTGCTCACG CAGCACCTCTGAGAGTACAGCCG CCCTGGGCTGCCTGGTAAAGGAC TACTTTCCCGAACCAGTCACTGTG TCCTGGAATAGCGGGGCCTTGAC CTCTGGAGTGCACACATTTCCAGC TGTACTGCAGTCATCTGGACTCTA CAGCCTGTCCAGTGTGGTCACCGT ACCTTCCTCCAACTTTGGCACTCA AACATATACATGTAACGTGGATCA TAAGCCCTCTAACACCAAAGTGGA TAAAACTGTGGAGCGTAAGTGTTG TGTCGAGTGTCCTCCTTGTCCTGC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TCCTCCTGTGGCAGGCCCATCTGT GTTTCTCTTTCCCCCAAAGCCAAA GGACACTTTGATGATATCCCGGAC CCCTGAGGTGACTTGCGTCGTCGT AGATGTTTCACACGAAGATCCAGA GGTGCAGTTCAACTGGTACGTGGA TGGCGTGGAAGTGCATAATGCCAA GACAAAGCCCCGCGAAGAGCAGT TTAATTCCACCTTCCGCGTGGTGT CTGTGCTGACCGTGGTACATCAGG ATTGGCTTAACGGTAAGGAGTACA AGTGCAAGGTGAGTAACAAGGGG CTGCCCGCCCCTATCGAGAAGACT ATCAGTAAAACCAAGGGCCAGCCA AGGGAGCCACAGGTGTACACACTT CCACCATCTAGGGAGGAAATGACA AAGAACCAGGTGAGTTTGACCTGT CTCGTGAAAGGCTTTTATCCCAGT GATATAGCCGTGGAATGGGAAAGT AACGGGCAGCCCGAGAACAACTA TAAGACCACACCACCCATGCTGGA CTCCGACGGTTCTTTCTTCCTTTAT AGCAAGCTGACAGTGGATAAATCC AGGTGGCAGCAGGGTAACGTATT CAGTTGCAGTGTCATGCACGAGG CACTCCACAACCACTATACTCAGA AAAGTCTTTCCCTGAGTCCAGGCA AG |
| SEQ ID 2389 | QVQLQQWGAGLLKPSE TLSLTCAVYGGSFSGYY WSWIRQPPGKGLEWIG EINHSGSTNYNPSLKSR VTISVDTSKNQFSLKLSS VTAADTAVYYCARGRP APSWVKTRNWFDPWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2497 | CAGGTGCAGCTACAGCAGTGGGG CGCAGGACTGTTGAAGCCTTCGG AGACCCTGTCCCTCACCTGCGCTG TCTATGGTGGGTCCTTCAGTGGTT ACTACTGGAGCTGGATCCGCCAG CCCCCAGGGAAGGGGCTGGAGTG GATTGGGGAAATCAATCATAGTGG AAGCACCAACTACAACCCGTCCCT CAAGAGTCGAGTCACCATATCAGT AGACACGTCCAAGAACCAGTTCTC CCTGAAGCTGAGCTCTGTGACCG CCGCGGACACGGCTGTGTATTACT GTGCGAGAGGCCGCCCCGCCCCA TCCTGGGTTAAAACCCGTAACTGG TTCGACCCCTGGGGCCAGGGAAC CCTGGTCACCGTCTCCTCAGCAAG CACAAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2390 | QVQLQQSGPGLVKPSQ TLSLTCAISGDSVSSNS AAWNWIRQSPSRGLEW LGRTYYRSKWYNDYAV SVKSRITINPDTSKNQFS LQLNSVTPEDTQVYYCA REASSGWNWGQGTLV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2498 | CAGGTACAGCTGCAGCAGTCAGG TCCAGGACTGGTGAAGCCCTCGC AGAGCCCTCTCACTCACCTGTGCCA TCTCCGGGGACAGTGTCTCTAGCA ACAGTGCTGCTTGGAACTGGATCA GGCAGTCCCCATCGAGAGGCCTT GAGTGGCTGGGAAGGACATACTA CAGGTCCAAGTGGTATAATGATTA TGCAGTATCTGTGAAAAGTCGAAT AACCATCAACCCAGACACATCCAA GAACCAGTTCTCCCTGCAGCTGAA CTCTGTGACTCCCGAGGACACGG CTGTGTATTACTGTGCAAGAGAGG CTAGCAGTGGCTGGAACTGGGGC CAGGGAACCCTGGTCACCGTCTC CTCAGCAAGCACAAAAGGTCCTTC AGTGTTCCCTCTGGCACCTTGCTC ACGCAGCACCTCTGAGAGTACAG CCGCCCTGGGCTGCCTGGTAAAG GACTACTTTCCCGAACCAGTCACT GTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2391 | QVQLQESGPGLVKPSQ TLSLTCAISGDSVSSNN AAWNWIRQSPSRGLEW LGRTFYRSKWYNDYAV SVKSRLTVNPDTSKNQF SLRLNSVSPEDTAVYYC ARGGRYTKGGYFDDW | SEQ ID 2499 | CAGGTGCAGCTGCAGGAGTCCGG TCCAGGACTGGTGAAGCCCTCGC AGAGCCCTCTCACTCACCTGTGCCA TCTCCGGGGACAGTGTCTCTAGCA ACAATGCTGCTTGGAACTGGATCA GGCAGTCCCCATCGAGAGGCCTT GAGTGGCTGGGAAGGACATTCTA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | GQGTLVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | CAGGTCCAAGTGGTATAATGACTA TGCAGTTTCTGTGAAAAGTCGACT AACCGTCAACCCAGACACATCCAA GAACCAGTTCTCCCTGCGGTTGAA CTCTGTGAGTCCCGAGGACACGG CTGTGTATTACTGTGCAAGAGGGG GAAGATATACCAAGGGAGGGTACT TTGACGACTGGGGCCAGGGAACC CTGGTGACCGTCTCCTCAGCAAGC ACAAAAGGTCCTTCAGTGTTCCCT CTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2392 | QVTLKESGPTLVKPTQT LTLTCTFSGFSLSTSGV GVGWIRQPPGKALEWL ALIYWDDDKRYSPSLKS RLTITKDTSKNQVVLTM TNMDPVDTATYYCAHR LDSSGRGGYFDYWGQ GTLVTVSSASTKGPSVF PLAPCSRSTSESTAALG CLVKDYFPEPVTVSWN SGALTSGVHTFPAVLQS SGLYSLSSVVTVPSSNF GTQTYTCNVDHKPSNT KVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD | SEQ ID 2500 | CAGGTCACCTTGAAGGAGTCTGGT CCTACGCTGGTGAAACCCACACAG ACCCTCACGCTGACCTGCACCTTC TCTGGGTTCTCACTCAGCACTAGT GGAGTGGGTGTGGGCTGGATCCG TCAGCCCCCAGGAAAGGCCCTGG AGTGGCTTGCACTCATTTATTGGG ATGATGATAAGCGCTACAGCCCAT CTCTGAAGAGCAGGCTCACCATCA CCAAGGACACCTCCAAAAACCAGG TGGTCCTTACAATGACCAACATGG ACCCTGTGGACACAGCCACATATT ACTGTGCACACAGATTGGATAGCA GTGGCCGTGGTGGTTACTTTGACT ACTGGGGCCAGGGCACCCTGGTC ACCGTCTCCTCAGCAAGCACAAAA GGTCCTTCAGTGTTCCCTCTGGCA CCTTGCTCACGCAGCACCTCTGAG AGTACAGCCGCCCTGGGCTGCCT GGTAAAGGACTACTTTCCCGAACC AGTCACTGTGTCCTGGAATAGCGG GGCCTTGACCTCTGGAGTGCACA CATTTCCAGCTGTACTGCAGTCAT CTGGACTCTACAGCCTGTCCAGTG TGGTCACCGTACCTTCCTCCAACT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | KSRWQQGNVFSCSVM HEALHNHYTQKSLSLSP GK | | TTGGCACTCAAACATATACATGTAA CGTGGATCATAAGCCCTCTAACAC CAAAGTGGATAAAACTGTGGAGCG TAAGTGTTGTGTCGAGTGTCCTCC TTGTCCTGCTCCTCCTGTGGCAGG CCCATCTGTGTTTCTCTTTCCCCC AAAGCCAAAGGACACTTTGATGAT ATCCCGGACCCCTGAGGTGACTT GCGTCGTCGTAGATGTTTCACACG AAGATCCAGAGGTGCAGTTCAACT GGTACGTGGATGGCGTGGAAGTG CATAATGCCAAGACAAAGCCCCGC GAAGAGCAGTTTAATTCCACCTTC CGCGTGGTGTCTGTGCTGACCGT GGTACATCAGGATTGGCTTAACGG TAAGGAGTACAAGTGCAAGGTGAG TAACAAGGGGCTGCCCGCCCCTA TCGAGAAGACTATCAGTAAAACCA AGGGCCAGCCAAGGGAGCCACAG GTGTACACACTTCCACCATCTAGG GAGGAAATGACAAAGAACCAGGT GAGTTTGACCTGTCTCGTGAAAGG CTTTTATCCCAGTGATATAGCCGT GGAATGGGAAAGTAACGGGCAGC CCGAGAACAACTATAAGACCACAC CACCCATGCTGGACTCCGACGGTT CTTTCTTCCTTTATAGCAAGCTGAC AGTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2393 | EVQLVESGGGVVQPGR SLRLSCTASGFTFSSYG MHWVRQAPGKGLEWV AVISYDGSNKYYADSVK GRFTISRDNSKNTLYLQ MNSLRAEDTAVYYCAK ELVGTSSPYYYYYGM DVWGQGTMVTVSSAST KGPSVFPLAPCSRSTSE STAALGCLVKDYFPEPV TVSWNSGALTSGVHTF PAVLQSSGLYSLSSVVT VPSSNFGTQTYTCNVD HKPSNTKVDKTVERKC CVECPPCPAPPVAGPS VFLFPPKPKDTLMISRTP EVTCVVVDVSHEDPEV QFNWYVDGVEVHNAKT KPREEQFNSTFRVVSVL TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | SEQ ID 2501 | GAGGTGCAGCTGGTGGAGTCTGG GGGAGGCGTGGTCCAGCCTGGGA GGTCCCTGAGACTCTCCTGTACAG CCTCTGGATTCACCTTCAGTAGCT ATGGCATGCACTGGGTCCGCCAG GCTCCAGGCAAGGGGCTGGAGTG GGTGGCAGTTATATCATATGATGG AAGTAATAAATACTATGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAAAGAGTTGGTGGGTA CCAGCTCTCCTTATTACTACTACTA CTACGGTATGGACGTCTGGGGCC AAGGGACAATGGTCACCGTCTCTT CAGCAAGCACAAAAGGTCCTTCAG TGTTCCCTCTGGCACCTTGCTCAC GCAGCACCTCTGAGAGTACAGCC GCCCTGGGCTGCCTGGTAAAGGA CTACTTTCCCGAACCAGTCACTGT GTCCTGGAATAGCGGGGCCTTGA CCTCTGGAGTGCACACATTTCCAG CTGTACTGCAGTCATCTGGACTCT ACAGCCTGTCCAGTGTGGTCACC GTACCTTCCTCCAACTTTGGCACC CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG TGTCTGTGCTGACCGTGGTACATC AGGATTGGCTTAACGGTAAGGAGT ACAAGTGCAAGGTGAGTAACAAGG GGCTGCCCGCCCCTATCGAGAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | ACTATCAGTAAAACCAAGGGCCAG CCAAGGGAGCCACAGGTGTACAC ACTTCCACCATCTAGGGAGGAAAT GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2394 | QLQLQESGGGLVQPGG SLRLSCAASGFTVSSNY MSWVRQAPGKGLEWV SVIYSGGSTYYADSVKG RFTISRDNSKNTLYLQM NSLRAEDTAVYYCARDY YYGSGSSPWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2502 | CAGCTGCAGCTGCAGGAGTCGGG GGGAGGCTTGGTCCAGCCTGGGG GGTCCCTGAGACTCTCCTGTGCAG CCTCTGGATTCACCGTCAGTAGCA ACTACATGAGCTGGGTCCGCCAG GCTCCAGGGAAGGGGCTGGAGTG GGTCTCAGTTATTTATAGCGGTGG TAGCACATACTACGCAGACTCCGT GAAGGGCAGATTCACCATCTCCAG AGACAATTCCAAGAACACGCTGTA TCTTCAAATGAACAGCCTGAGAGC CGAGGACACGGCTGTGTATTACTG TGCGAGAGACTATTACTATGGTTC GGGGAGTTCTCCCTGGGGCCAGG GAACCCTGGTCACCGTCTCCTCAG CAAGCACAAAAGGTCCTTCAGTGT TCCCTCTGGCACCTTGCTCACGCA GCACCTCTGAGAGTACAGCCGCC CTGGGCTGCCTGGTAAAGGACTA CTTTCCCGAACCAGTCACTGTGTC CTGGAATAGCGGGGCCTTGACCT CTGGAGTGCACACATTTCCAGCTG TACTGCAGTCATCTGGACTCTACA GCCTGTCCAGTGTGGTCACCGTAC CTTCCTCCAACTTTGGCACTCAAA CATATACATGTAACGTGGATCATA AGCCCTCTAACACCAAAGTGGATA AAACTGTGGAGCGTAAGTGTTGTG TCGAGTGTCCTCCTTGTCCTGCTC CTCCTGTGGCAGGCCCATCTGTGT TTCTCTTTCCCCCAAAGCCAAAGG ACACTTTGATGATATCCCGGACCC CTGAGGTGACTTGCGTCGTCGTAG ATGTTTCACACGAAGATCCAGAGG TGCAGTTCAACTGGTACGTGGATG GCGTGGAAGTGCATAATGCCAAGA CAAAGCCCCGCGAAGAGCAGTTTA ATTCCACCTTCCGCGTGGTGTCTG TGCTGACCGTGGTACATCAGGATT GGCTTAACGGTAAGGAGTACAAGT GCAAGGTGAGTAACAAGGGGCTG CCCGCCCCTATCGAGAAGACTATC AGTAAAACCAAGGGCCAGCCAAG GGAGCCACAGGTGTACACACTTCC ACCATCTAGGGAGGAAATGACAAA GAACCAGGTGAGTTTGACCTGTCT CGTGAAAGGCTTTTATCCCAGTGA TATAGCCGTGGAATGGGAAAGTAA CGGGCAGCCCGAGAACAACTATA AGACCACACCACCCATGCTGGACT CCGACGGTTCTTTCTTCCTTTATAG CAAGCTGACAGTGGATAAATCCAG GTGGCAGCAGGGTAACGTATTCA GTTGCAGTGTCATGCACGAGGCA CTCCACAACCACTATACTCAGAAA AGTCTTTCCCTGAGTCCAGGCAAG |
| SEQ ID 2395 | QVQLQQWGAGLLKPSE TLSLTCAVYGGSFSGYY WSWIRQPPGKGLEWIG | SEQ ID 2503 | CAGGTGCAGCTACAGCAGTGGGG CGCAGGACTGTTGAAGCCTTCGG AGACCCTGTCCCTCACCTGCGCTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | EINHSGSTNYNPSLKSR VTISVDTSKNQFSLKLSS VTAADTAVYYCARGRP YCSSTSCYPEWFDPWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | | TCTATGGTGGTCCTTCAGTGGTT ACTACTGGAGCTGGATCCGCAG CCCCCAGGGAAGGGGCTGGAGTG GATTGGGGAAATCAATCATAGTGG AAGCACCAACTACAACCCGTCCCT CAAGAGTCGAGTCACCATATCAGT AGACACGTCCAAGAACCAGTTCTC CCTGAAGCTGAGCTCTGTGACCG CCGCGGACACGGCTGTGTATTACT GTGCGAGAGGCCGGCCATATTGT AGTAGTACCAGCTGCTACCCAGAG TGGTTCGACCCCTGGGGCCAGGG AACCCTGGTCACCGTCTCCTCAGC AAGCACAAAAGGTCCTTCAGTGTT CCCTCTGGCACCTTGCTCACGCAG CACCTCTGAGAGTACAGCCGCCCT GGGCTGCCTGGTAAAGGACTACTT TCCCGAACCAGTCACTGTGTCCTG GAATAGCGGGGCCTTGACCTCTG GAGTGCACACATTTCCAGCTGTAC TGCAGTCATCTGGACTCTACAGCC TGTCCAGTGTGGTCACCGTACCTT CCTCCAACTTTGGCACTCAAACAT ATACATGTAACGTGGATCATAAGC CCTCTAACACCAAAGTGGATAAAA CTGTGGAGCGTAAGTGTTGTGTCG AGTGTCCTCCTTGTCCTGCTCCTC CTGTGGCAGGCCCATCTGTGTTTC TCTTTCCCCCAAAGCCAAAGGACA CTTTGATGATATCCCGGACCCCTG AGGTGACTTGCGTCGTCGTAGATG TTTCACACGAAGATCCAGAGGTGC AGTTCAACTGGTACGTGGATGGCG TGGAAGTGCATAATGCCAAGACAA AGCCCCGCGAAGAGCAGTTTAATT CCACCTTCCGCGTGGTGTCTGTGC TGACCGTGGTACATCAGGATTGGC TTAACGGTAAGGAGTACAAGTGCA AGGTGAGTAACAAGGGGCTGCCC GCCCCTATCGAGAAGACTATCAGT AAAACCAAGGGCCAGCCAAGGGA GCCACAGGTGTACACACTTCCACC ATCTAGGGAGGAAATGACAAAGAA CCAGGTGAGTTTGACCTGTCTCGT GAAAGGCTTTTATCCCAGTGATAT AGCCGTGGAATGGGAAAGTAACG GGCAGCCCGAGAACAACTATAAGA CCACACCACCCATGCTGGACTCC GACGGTTCTTTCTTCCTTTATAGCA AGCTGACAGTGGATAAATCCAGGT GGCAGCAGGGTAACGTATTCAGTT GCAGTGTCATGCACGAGGCACTC CACAACCACTATACTCAGAAAAGT CTTTCCCTGAGTCCAGGCAAG |
| SEQ ID 2396 | QVTLKESGGGVVQPGR SLRLSCAASGFTFSSYG MHWVRQAPGKGLEWV AVISYDGSNKYYADSVK GRFTISRDNSKNTLYLQ MNSLRAEDTAVYYCAKL RGIDYYDSSGYQRGFD YWGQGTLVTVSSASTK GPSVFPLAPCSRSTSES TAALGCLVKDYFPEPVT VSWNSGALTSGVHTFP AVLQSSGLYSLSSVVTV PSSNFGTQTYTCNVDH KPSNTKVDKTVERKCCV ECPPCPAPPVAGPSVFL FPPKPKDTLMISRTPEV TCVVVDVSHEDPEVQF NWYVDGVEVHNAKTKP REEQFNSTFRVVSVLTV VHQDWLNGKEYKCKVS NKGLPAPIEKTISKTKGQ | SEQ ID 2504 | CAGGTCACCTTGAAGGAGTCTGG GGGAGGCGTGGTCCAGCCTGGGA GGTCCCTGAGACTCTCCTGTGCAG CCTCTGGATTCACCTTCAGTAGCT ATGGCATGCACTGGGTCCGCCAG GCTCCAGGCAAGGGGCTGGAGTG GGTGGCAGTTATATCATATGATGG AAGTAATAAATACTATGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAAATTAAGGGGTATAGA TTACTATGATAGTAGTGGTTACCAA CGGGGGTTTGACTACTGGGGCCA GGGAACCCTGGTCACCGTCTCCT CAGCAAGCACAAAAGGTCCTTCAG TGTTCCCTCTGGCACCTTGCTCAC GCAGCACCTCTGAGAGTACAGCC GCCCTGGGCTGCCTGGTAAAGGA CTACTTTCCCGAACCAGTCACTGT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | PREPQVYTLPPSREEMT KNQVSLTCLVKGFYPSD IAVEWESNGQPENNYK TTPPMLDSDGSFFLYSK LTVDKSRWQQGNVFSC SVMHEALHNHYTQKSL SLSPGK | | GTCCTGGAATAGCGGGGCCTTGA CCTCTGGAGTGCACACATTTCCAG CTGTACTGCAGTCATCTGGACTCT ACAGCCTGTCCAGTGTGGTCACC GTACCTTCCTCCAACTTTGGCACT CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG TGTCTGTGCTGACCGTGGTACATC AGGATTGGCTTAACGGTAAGGAGT ACAAGTGCAAGGTGAGTAACAAGG GGCTGCCCGCCCCTATCGAGAAG ACTATCAGTAAAACCAAGGGCCAG CCAAGGGAGCCACAGGTGTACAC ACTTCCACCATCTAGGGAGGAAAT GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2397 | QVQLQESGPGLVKPSE TLSLTCTVSGGSISSYY WSWIRQPPGKGLEWIG YIYYTGSTNYNPSLKSR VTISVDTSKNQFSLKLSS VTTADTAVYYCARGGR GDGAAFDIWGQGTMVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2505 | CAGGTGCAGCTGCAGGAGTCCGG CCCAGGACTGGTGAAGCCTTCGG AGACCCTGTCCCTCACCTGCACTG TCTCTGGTGGCTCCATCAGTAGTT ACTACTGGAGCTGGATCCGGCAG CCCCCAGGGAAGGGACTGGAGTG GATTGGCTATATCTATTACACTGG GAGCACCAACTACAACCCCTCCA CAAGAGCCGAGTCACCATATCAGT AGACACGTCCAAGAACCAGTTCTC CCTGAAGCTGAGCTCTGTGACCAC TGCGGACACGGCCGTGTATTACTG TGCGAGAGGTGGGAGGGGGGATG GGGCCGCTTTTGACATCTGGGGC CAAGGGACAATGGTCACCGTCTCT TCAGCAAGCACAAAAGGTCCTTCA GTGTTCCCTCTGGCACCTTGCTCA CGCAGCACCTCTGAGAGTACAGC CGCCCTGGGCTGCCTGGTAAAGG ACTACTTTCCCGAACCAGTCACTG TGTCCTGGAATAGCGGGGCCTTG ACCTCTGGAGTGCACACATTTCCA GCTGTACTGCAGTCATCTGGACTC TACAGCCTGTCCAGTGTGGTCACC GTACCTTCCTCCAACTTTGGCACT CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TGTCTGTGCTGACCGTGGTACATC AGGATTGGCTTAACGGTAAGGAGT ACAAGTGCAAGGTGAGTAACAAGG GGCTGCCCGCCCCTATCGAGAAG ACTATCAGTAAAACCAAGGGCCAG CCAAGGGAGCCACAGGTGTACAC ACTTCCACCATCTAGGGAGGAAAT GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2398 | QVQLVQSGGGVVQPGR SLRLSCAASGFTFSSSA AMIWHDESKKYYADSV KGRFTISRDNSKNTLYL QMNSLRAEDTAVYYCA RPPDGNSGRWYFDL WGRGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2506 | CAGGTGCAGCTGGTGCAATCTGG GGGAGGCGTGGTCCAGCCTGGGA GGTCCCTGAGACTCTCCTGTGCAG CGTCTGGATTCACCTTCAGCAGCT CTGCCATGCACTGGGTCCGCCAG GCTCCAGGCAAGGGACTGGAGTG GGTGGCAATGATTTGGCATGATGA GAGTAAGAAATACTATGCAGACTC CGTGAAGGGCCGATTCACTATCTC CAGAGACAATTCCAAGAACACGCT GTATCTGCAAATGAACAGCCTGAG AGCTGAGGACACGGCTGTGTATTA CTGTGCGAGACCCCCCGACGGTG GTAACTCCGGTCGCTGGTACTTCG ATCTCTGGGGCCGTGGCACCCTG GTCACCGTCTCCTCAGCAAGCACA AAAGGTCCTTCAGTGTTCCCTCTG GCACCTTGCTCACGCAGCACCTCT GAGAGTACAGCCGCCCTGGGCTG CCTGGTAAAGGACTACTTTCCCGA ACCAGTCACTGTGTCCTGGAATAG CGGGGCCTTGACCTCTGGAGTYC ACACATTTCCAGCTGTACTGCAGT CATCTGGACTCTACAGCCTGTCCA GTGTGGTCACCGTACCTTCCTCCA ACTTTGGCACTCAAACATATACAT GTAACGTGGATCATAAGCCCTCTA ACACCAAAGTGGATAAAACTGTGG AGCGTAAGTGTTGTGTCGAGTGTC CTCCTTGTCCTGCTCCTCCTGTGG CAGGCCCATCTGTGTTTCTCTTTC CCCCAAAGCCAAAGGACACTTTGA TGATATCCCGGACCCCTGAGGTGA CTTGCGTCGTCGTAGATGTTTCAC ACGAAGATCCAGAGGTGCAGTTCA ACTGGTACGTGGATGGCGTGGAA GTGCATAATGCCAAGACAAAGCCC CGCGAAGAGCAGTTTAATTCCACC TTCCGCGTGGTGTCTGTGCTGACC GTGGTACATCAGGATTGGCTTAAC GGTAAGGAGTACAAGTGCAAGGT GAGTAACAAGGGGCTGCCCGCCC CTATCGAGAAGACTATCAGTAAAA CCAAGGGCCAGCCAAGGGAGCCA CAGGTGTACACACTTCCACCATCT AGGGAGGAAATGACAAAGAACCA GGTGAGTTTGACCTGTCTCGTGAA AGGCTTTTATCCCAGTGATATAGC CGTGGAATGGGAAAGTAACGGGC AGCCCGAGAACAACTATAAGACCA CACCACCCATGCTGGACTCCGAC GGTTCTTTCTTCCTTTATAGCAAGC TGACAGTGGATAAATCCAGGTGGC AGCAGGGTAACGTATTCAGTTGCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGTCATGCACGAGGCACTCCACA |
| | | | ACCACTATACTCAGAAAAGTCTTTC |
| | | | CCTGAGTCCAGGCAAG |
| SEQ ID 2399 | QMQLVQSGGGLVQPG GSLRLSCAASGFTFSSY AMSWVRQAPGKGLEW VSAISGSGGSTYYADSV KGRFTISRDNSKNTLYL QMNSLRAEDTAVYYCA KDKNVRKHDYGDHPYG GYFDYWGQGTLVTVSS ASTKGPSVFPLAPCSRS TSESTAALGCLVKDYFP EPVTVSWNSGALTSGV HTFPAVLQSSGLYSLSS VVTVPSSNFGTQTYTCN VDHKPSNTKVDKTVERK CCVECPPCPAPPVAGP SVFLFPPKPKDTLMISRT PEVTCVVVDVSHEDPEV QFNWYVDGVEVHNAKT KPREEQFNSTFRVVSVL TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | SEQ ID 2507 | CAGATGCAGCTGGTGCAATCTGG GGGAGGCTTGGTACAGCCTGGGG GGTCCCTGAGACTCTCCTGTGCAG CCTCTGGATTCACCTTTAGCAGCT ATGCCATGAGCTGGGTCCGCCAG GCTCCAGGGAAGGGGCTGGAGTG GGTCTCAGCTATTAGTGGTAGTGG TGGTAGCACATACTACGCAGACTC CGTGAAGGGCCGGTTCACCATCT CCAGAGACAATTCCAAGAACACGC TGTATCTGCAAATGAACAGCCTGA GAGCCGAGGACACGGCCGTATAT TACTGTGCGAAAGACAAGAACGTC CGAAAACATGACTACGGTGACCAC CCCTACGGGGGTACTTTGACTAC TGGGGCCAGGGCACCCTGGTGAC CGTCTCCTCAGCAAGCACAAAGG TCCTTCAGTGTTCCCTCTGGCACC TTGCTCACGCAGCACCTCTGAGAG TACAGCCGCCCTGGGCTGCCTGG TAAAGGACTACTTTCCCGAACCAG TCACTGTGTCCTGGAATAGCGGG GCCTTGACCTCTGGAGTGCACACA TTTCCAGCTGTACTGCAGTCATCT GGACTCTACAGCCTGTCCAGTGTG GTCACCGTACCTTCCTCCAACTTT GGCACTCAAACATATACATGTAAC GTGGATCATAAGCCCTCTAACACC AAAGTGGATAAAACTGTGGAGCGT AAGTGTTGTGTCGAGTGTCCTCCT TGTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2400 | EVQLVQSGAEVKKPGA SVKVSCKASGYTFTSYA MHWRQAPGQRLEWM GWINAGNGNTKYSQKF QGRVTITRDTSASTAYM ELSSLRSEDTAVYYCAR VAGATSLWYWGQGTLV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT | SEQ ID 2508 | GAGGTCCAGCTGGTACAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGAGTG GATGGGATGGATCAACGCTGGCA ATGGTAACACAAAATATTCACAGA AGTTCCAGGGCAGAGTCACCATTA CCAGGGACACATCCGCGAGCACA GCCTACATGGAGCTGAGCAGCCT GAGATCTGAAGACACGGCTGTGTA TTACTGTGCGAGAGTGGCGGGAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | VERKCCVECPPCPAPP<br>VAGPSVFLFPPKPKDTL<br>MISRTPEVTCVVVDVSH<br>EDPEVQFNWYVDGVEV<br>HNAKTKPREEQFNSTFR<br>VVSVLTVVHQDWLNGK<br>EYKCKVSNKGLPAPIEK<br>TISKTKGQPREPQVYTL<br>PPSREEMTKNQVSLTCL<br>VKGFYPSDIAVEWESNG<br>QPENNYKTTPPMLDSD<br>GSFFLYSKLTVDKSRW<br>QQGNVFSCSVMHEALH<br>NHYTQKSLSLSPGK | | CTACTTCCCTATGGTACTGGGGCC<br>AGGGCACCCTGGTCACCGTCTCC<br>TCAGCAAGCACAAAAGGTCCTTCA<br>GTGTTCCCTCTGGCACCTTGCTCA<br>CGCAGCACCTCTGAGAGTACAGC<br>CGCCCTGGGCTGCCTGGTAAAGG<br>ACTACTTTCCCGAACCAGTCACTG<br>TGTCCTGGAATAGCGGGGCCTTG<br>ACCTCTGGAGTGCACACATTTCCA<br>GCTGTACTGCAGTCATCTGGACTC<br>TACAGCCTGTCCAGTGTGGTCACC<br>GTACCTTCCTCCAACTTTGGCACT<br>CAAACATATACATGTAACGTGGAT<br>CATAAGCCCTCTAACACCAAAGTG<br>GATAAAACTGTGGAGCGTAAGTGT<br>TGTGTCGAGTGTCCTCCTTGTCCT<br>GCTCCTCCTGTGGCAGGCCCATCT<br>GTGTTTCTCTTTCCCCCAAAGCCA<br>AAGGACACTTTGATGATATCCCGG<br>ACCCCTGAGGTGACTTGCGTCGTC<br>GTAGATGTTTCACACGAAGATCCA<br>GAGGTGCAGTTCAACTGGTACGTG<br>GATGGCGTGGAAGTGCATAATGC<br>CAAGACAAAGCCCCGCGAAGAGC<br>AGTTTAATTCCACCTTCCGCGTGG<br>TGTCTGTGCTGACCGTGGTACATC<br>AGGATTGGCTTAACGGTAAGGAGT<br>ACAAGTGCAAGGTGAGTAACAAGG<br>GCTGCCCGCCCCTATCGAGAAG<br>ACTATCAGTAAAACCAAGGGCCAG<br>CCAAGGGAGCCACAGGTGTACAC<br>ACTTCCACCATCTAGGGAGGAAAT<br>GACAAAGAACCAGGTGAGTTTGAC<br>CTGTCTCGTGAAAGGCTTTTATCC<br>CAGTGATATAGCCGTGGAATGGGA<br>AAGTAACGGGCAGCCCGAGAACA<br>ACTATAAGACCACACCACCCATGC<br>TGGACTCCGACGGTTCTTTCTTCC<br>TTTATAGCAAGCTGACAGTGGATA<br>AATCCAGGTGGCAGCAGGGTAAC<br>GTATTCAGTTGCAGTGTCATGCAC<br>GAGGCACTCCACAACCACTATACT<br>CAGAAAAGTCTTTCCCTGAGTCCA<br>GGCAAG |
| SEQ ID 2401 | QVQLQQSGPGLVKPSQ<br>SLSLTCAISGDSVSSNS<br>AAWNWIRQSPSRGLEW<br>LGRTYYRSKWYNDYAV<br>SVKSRITIKPDTSKNQFS<br>LQLNSVTPEDTAVYYCT<br>RLANSDGVDVWGQGT<br>MVTVSSASTKGPSVFPL<br>APCSRSTSESTAALGCL<br>VKDYFPEPVTVSWNSG<br>ALTSGVHTFPAVLQSSG<br>LYSLSSVVTVPSSNFGT<br>QTYTCNVDHKPSNTKV<br>DKTVERKCCVECPPCP<br>APPVAGPSVFLFPPKPK<br>DTLMISRTPEVTCVVVD<br>VSHEDPEVQFNWYVDG<br>VEVHNAKTKPREEQFN<br>STFRVVSVLTVVHQDWL<br>NGKEYKCKVSNKGLPA<br>PIEKTISKTKGQPREPQV<br>YTLPPSREEMTKNQVSL<br>TCLVKGFYPSDIAVEWE<br>SNGQPENNYKTTPPML<br>DSDGSFFLYSKLTVDKS<br>RWQQGNVFSCSVMHE<br>ALHNHYTQKSLSLSPGK | SEQ ID 2509 | CAGGTACAGCTGCAGCAGTCAGG<br>TCCAGGACTGGTGAAGCCCTCGC<br>AGAGCCTCTCACTCACCTGTGCCA<br>TCTCCGGGGACAGTGTCTCTAGCA<br>ACAGTGCTGCTTGGAACTGGATCA<br>GGCAGTCCCCATCGAGAGGCCTT<br>GAGTGGCTGGGAAGGACATACTA<br>CAGGTCCAAGTGGTATAATGATTA<br>TGCAGTATCTGTGAAGAGTCCAAT<br>AACCATCAAACCAGACACATCCAA<br>GAACCAGTTCTCCCTGCAGCTGAA<br>CTCTGTGACTCCCGAGGACACGG<br>CTGTGTATTACTGTACAAGGCTAG<br>CTAATTCCGACGGTGTGGACGTCT<br>GGGGCCAAGGGACAATGGTCACC<br>GTCTCCTCAGCAAGCACAAAAGGT<br>CCTTCAGTGTTCCCTCTGGCACCT<br>TGCTCACGCAGCACCTCTGAGAGT<br>ACAGCCGCCCTGGGCTGCCTGGT<br>AAAGGACTACTTTCCCGAACCAGT<br>CACTGTGTCCTGGAATAGCGGGG<br>CCTTGACCTCTGGAGTGCACACAT<br>TTCCAGCTGTACTGCAGTCATCTG<br>GACTCTACAGCCTGTCCAGTGTGG<br>TCACCGTACCTTCCTCCAACTTTG<br>GCACTCAAACATATACATGTAACG<br>TGGATCATAAGCCCTCTAACACCA<br>AAGTGGATAAAACTGTGGAGCGTA<br>AGTGTTGTGTCGAGTGTCCTCCTT<br>GTCCTGCTCCTCCTGTGGCAGGC<br>CCATCTGTGTTTCTCTTTCCCCCAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGCCAAAGGACACTTTGATGATAT
CCCGGACCCCTGAGGTGACTTGC
GTCGTCGTAGATGTTTCACACGAA
GATCCAGAGGTGCAGTTCAACTGG
TACGTGGATGGCGTGGAAGTGCA
TAATGCCAAGACAAAGCCCCGCGA
AGAGCAGTTTAATTCCACCTTCCG
CGTGGTGTCTGTGCTGACCGTGG
TACATCAGGATTGGCTTAACGGTA
AGGAGTACAAGTGCAAGGTGAGTA
ACAAGGGGCTGCCCGCCCCTATC
GAGAAGACTATCAGTAAAACCAAG
GGCCAGCCAAGGGAGCCACAGGT
GTACACACTTCCACCATCTAGGGA
GGAAATGACAAAGAACCAGGTGA
GTTTGACCTGTCTCGTGAAAGGCT
TTTATCCCAGTGATATAGCCGTGG
AATGGGAAAGTAACGGGCAGCCC
GAGAACAACTATAAGACCACACCA
CCCATGCTGGACTCCGACGGTTCT
TTCTTCCTTTATAGCAAGCTGACA
GTGGATAAATCCAGGTGGCAGCA
GGGTAACGTATTCAGTTGCAGTGT
CATGCACGAGGCACTCCACAACCA
CTATACTCAGAAAAGTCTTTCCCT
GAGTCCAGGCAAG |
| SEQ ID 2402 | QVQLQQSGPGLVKPSQ
TLSLTCAISGDSVSSDS
AVWTWIRQSPSRGLEW
LGRTYYKSKWYNDYAA
SVKSRITINPDTSKNQFS
LHLNSVTPEDTAVYYCA
RGVTRTFDYWGQGTTV
TVSSASTKGPSVFPLAP
CSRSTSESTAALGCLVK
DYFPEPVTVSWNSGAL
TSGVHTFPAVLQSSGLY
SLSSVVTVPSSNFGTQT
YTCNVDHKPSNTKVDKT
VERKCCVECPPCPAPP
VAGPSVFLFPPKPKDTL
MISRTPEVTCVVVDVSH
EDPEVQFNWYVDGVEV
HNAKTKPREEQFNSTFR
VVSVLTVVHQDWLNGK
EYKCKVSNKGLPAPIEK
TISKTKGQPREPQVYTL
PPSREEMTKNQVSLTCL
VKGFYPSDIAVEWESNG
QPENNYKTTPPMLDSD
GSFFLYSKLTVDKSRW
QQGNVFSCSVMHEALH
NHYTQKSLSLSPGK | SEQ ID 2510 | CAGGTACAGCTGCAGCAGTCAGG
TCCAGGACTGGTGAAGCCCTCGC
AGACCCTCTCACTCACCTGTGCCA
TCTCCGGGGACAGTGTCTCTAGC
GACAGTGCTGTTTGGACCTGGATC
AGGCAGTCCCCATCGAGAGGCCT
TGAGTGGCTGGGAAGGACATACTA
CAAGTCGAAGTGGTATAATGATTA
TGCAGCATCTGTGAAAAGTCGAAT
AACCATCAACCCAGACACATCCAA
GAACCAGTTCTCCCTGCACCTGAA
CTCTGTGACTCCCGAGGACACGG
CTGTGTATTACTGTGCAAGAGGTG
TAACCCGGACCTTTGACTACTGGG
GCCAGGGGACCACGGTCACCGTC
TCCTCAGCAAGCACAAAAGGTCCT
TCAGTGTTCCCTCTGGCACCTTGC
TCACGCAGCACCTCTGAGAGTACA
GCCGCCCTGGGCTGCCTGGTAAA
GGACTACTTTCCCGAACCAGTCAC
TGTGTCCTGGAATAGCGGGGCCTT
GACCTCTGGAGTGCACACATTTCC
AGCTGTACTGCAGTCATCTGGACT
CTACAGCCTGTCCAGTGTGGTCAC
CGTACCTTCCTCCAACTTTGGCAC
TCAAACATATACATGTAACGTGGA
TCATAAGCCCTCTAACACCAAAGT
GGATAAAACTGTGGAGCGTAAGTG
TTGTGTCGAGTGTCCTCCTTGTCC
TGCTCCTCCTGTGGCAGGCCCATC
TGTGTTTCTCTTTCCCCCAAAGCC
AAAGGACACTTTGATGATATCCCG
GACCCCTGAGGTGACTTGCGTCG
TCGTAGATGTTTCACACGAAGATC
CAGAGGTGCAGTTCAACTGGTACG
TGGATGGCGTGGAAGTGCATAATG
CCAAGACAAAGCCCCGCGAAGAG
CAGTTTAATTCCACCTTCCGCGTG
GTGTCTGTGCTGACCGTGGTACAT
CAGGATTGGCTTAACGGTAAGGAG
TACAAGTGCAAGGTGAGTAACAAG
GGGCTGCCCGCCCCTATCGAGAA
GACTATCAGTAAAACCAAGGGCCA
GCCAAGGGAGCCACAGGTGTACA
CACTTCCACCATCTAGGGAGGAAA
TGACAAAGAACCAGGTGAGTTTGA
CCTGTCTCGTGAAAGGCTTTTATC
CCAGTGATATAGCCGTGGAATGG
GAAAGTAACGGGCAGCCCGAGAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CAACTATAAGACCACACCACCCAT GCTGGACTCCGACGGTTCTTTCTT CCTTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2403 | QLQLQESGPGLVKPSQ TLSLTCAISGDSVSSNS AAWNWIRQSPSRGLEW LGRTYYRSKWYNDYAV SVKSRITINPDTSKNQFS LQLNSVTPEDTAVYYCA EGNGPFDPWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2511 | CAGCTGCAGCTGCAGGAGTCGGG TCCAGGACTGGTGAAGCCCTCGC AGACCCTCTCACTCACCTGTGCCA TCTCCGGGGACAGTGTCTCTAGCA ACAGTGCTGCTTGGAACTGGATCA GGCAGTCCCCATCGAGAGGCCTT GAGTGGCTGGGAAGGACATACTA CAGGTCCAAGTGGTATAATGATTA TGCAGTATCTGTGAAAAGTCGAAT AACCATCAACCCAGACACATCCAA GAACCAGTTCTCCCTGCAGCTGAA CTCTGTGACTCCCGAGGACACGG CTGTGTATTACTGTGCAGAAGGCA ATGGGCCGTTCGACCCCTGGGGC CAGGGAACCCTGGTGACCGTCTC CTCAGCAAGCACAAAAGGTCCTTC AGTGTTCCCTCTGGCACCTTGCTC ACGCAGCACCTCTGAGAGTACAG CCGCCCTGGGCTGCCTGGTAAAG GACTACTTTCCCGAACCAGTCACT GTGTCCTGGAATAGCGGGGCCTT GACCCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2404 | QITLKESGGGVVQPGRS LRLSCVASGFTFSTYPM HWVRQAPGKGLEWA VISYDGRNEYYADSVKG RFTISRDNSKNTLYLQM NSLRAEDTAVYYCATRD TPLVGVSIYWGQGTLVT VSSASTKGPSVFPLAPC SRSTSESTAALGCLVKD | SEQ ID 2512 | CAGATCACCTTGAAGGAGTCTGGG GGAGGCGTGGTCCAGCCTGGGAG GTCCCTGAGACTCTCCTGTGTAGC CTCTGGATTCACCTTCAGTACCTA TCCCATGCACTGGGTCCGCCAGG CTCCAGGCAAGGGGCTGGAGTGG GTGGCAGTTATATCATATGATGGA CGTAATGAATACTACGCAGACTCC GTGAAGGGCCGATTCACCATCTCC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | YFPEPVTVSWNSGALTS<br>GVHTFPAVLQSSGLYSL<br>SSVVTVPSSNFGTQTYT<br>CNVDHKPSNTKVDKTV<br>ERKCCVECPPCPAPPV<br>AGPSVFLFPPKPKDTLM<br>ISRTPEVTCVVVDVSHE<br>DPEVQFNWYVDGVEVH<br>NAKTKPREEQFNSTFRV<br>VSVLTVVHQDWLNGKE<br>YKCKVSNKGLPAPIEKTI<br>SKTKGQPREPQVYTLPP<br>SREEMTKNQVSLTCLVK<br>GFYPSDIAVEWESNGQ<br>PENNYKTTPPMLDSDG<br>SFFLYSKLTVDKSRWQ<br>QGNVFSCSVMHEALHN<br>HYTQKSLSLSPGK | | AGAGACAATTCCAAAAACACGCTG<br>TATCTGCAAATGAACAGTCTGCGA<br>GCTGAAGACACGGCTGTCTATTAT<br>TGTGCGACTCGGGATACACCTTTG<br>GTTGGGGTTTCGATATACTGGGGC<br>CAGGGCACCCTGGTCACCGTCTC<br>CTCAGCAAGCACAAAAGGTCCTTC<br>AGTGTTCCCTCTGGCACCTTGCTC<br>ACGCAGCACCTCTGAGAGTACAG<br>CCGCCCTGGGCTGCCTGGTAAAG<br>GACTACTTTCCCGAACCAGTCACT<br>GTGTCCTGGAATAGCGGGGCCTT<br>GACCTCTGGAGTGCACACATTTCC<br>AGCTGTACTGCAGTCATCTGGACT<br>CTACAGCCTGTCCAGTGTGGTCAC<br>CGTACCTTCCTCCAACTTTGGCAC<br>TCAAACATATACATGTAACGTGGA<br>TCATAAGCCCTCTAACACCAAAGT<br>GGATAAAACTGTGGAGCGTAAGTG<br>TTGTGTCGAGTGTCCTCCTTGTCC<br>TGCTCCTCCTGTGGCAGGCCCATC<br>TGTGTTTCTCTTTCCCCCAAAGCC<br>AAAGGACACTTTGATGATATCCCG<br>GACCCCTGAGGTGACTTGCGTCG<br>TCGTAGATGTTTCACACGAAGATC<br>CAGAGGTGCAGTTCAACTGGTACG<br>TGGATGGCGTGGAAGTGCATAATG<br>CCAAGACAAAGCCCCGCGAAGAG<br>CAGTTTAATTCCACCTTCCGCGTG<br>GTGTCTGTGCTGACCGTGGTACAT<br>CAGGATTGGCTTAACGGTAAGGAG<br>TACAAGTGCAAGGTGAGTAACAAG<br>GGGCTGCCCCGCCCCTATCGAGAA<br>GACTATCAGTAAAACCAAGGGCCA<br>GCCAAGGGAGCCACAGGTGTACA<br>CACTTCCACCATCTAGGGAGGAAA<br>TGACAAAGAACCAGGTGAGTTTGA<br>CCTGTCTCGTGAAAGGCTTTTATC<br>CCAGTGATATAGCCGTGGAATGG<br>GAAAGTAACGGGCAGCCCGAGAA<br>CAACTATAAGACCACACCACCCAT<br>GCTGGACTCCGACGGTTCTTTCTT<br>CCTTTATAGCAAGCTGACAGTGGA<br>TAAATCCAGGTGGCAGCAGGGTAA<br>CGTATTCAGTTGCAGTGTCATGCA<br>CGAGGCACTCCACAACCACTATAC<br>TCAGAAAAGTCTTTCCCTGAGTCC<br>AGGCAAG |
| SEQ ID 2405 | QMQLVQSGGGLVKAGG<br>SLRLSCSASGFTFSSYA<br>MHWVRQAPGKGLEYVS<br>AISSNGGSTYYADSVKG<br>RFTISRDNSKNTLYLQM<br>SSLRAEDTAVYYCVNRA<br>GYGDYRHFQHWGQGT<br>LVTVSSASTKGPSVFPL<br>APCSRSTSESTAALGCL<br>VKDYFPEPVTVSWNSG<br>ALTSGVHTFPAVLQSSG<br>LYSLSSVVTVPSSNFGT<br>QTYTCNVDHKPSNTKV<br>DKTVERKCCVECPPCP<br>APPVAGPSVFLFPPKPK<br>DTLMISRTPEVTCVVVD<br>VSHEDPEVQFNWYVDG<br>VEVHNAKTKPREEQFN<br>STFRVVSVLTVVHQDWL<br>NGKEYKCKVSNKGLPA<br>PIEKTISKTKGQPREPQV<br>YTLPPSREEMTKNQVSL<br>TCLVKGFYPSDIAVEWE<br>SNGQPENNYKTTPPML<br>DSDGSFFLYSKLTVDKS<br>RWQQGNVFSCSVMHE<br>ALHNHYTQKSLSLSPGK | SEQ ID 2513 | CAGATGCAGCTGGTGCAATCTGG<br>GGGAGGCCTGGTCAAGGCTGGGG<br>GGTCCCTGAGACTCTCCTGTTCAG<br>CCTCTGGATTCACCTTCAGTAGCT<br>ATGCTATGCACTGGGTCCGCCAG<br>GCTCCAGGGAAGGGACTGGAATA<br>TGTTTCAGCTATTAGTAGTAATGG<br>GGGTAGCACATACTACGCAGACTC<br>AGTGAAGGGCAGATTCACCATCTC<br>CAGAGACAATTCCAAGAACACGCT<br>GTATCTTCAAATGAGCAGTCTGAG<br>AGCTGAGGACACGGCTGTGTATTA<br>CTGTGTGAATCGGGCGGGTTACG<br>GTGACTACAGACACTTCCAGCACT<br>GGGGCCAGGGCACCCTGGTCACC<br>GTCTCCTCAGCAAGCACAAAAGGT<br>CCTTCAGTGTTCCCTCTGGCACCT<br>TGCTCACGCAGCACCTCTGAGAGT<br>ACAGCCGCCCTGGGCTGCCTGGT<br>AAAGGACTACTTTCCCGAACCAGT<br>CACTGTGTCCTGGAATAGCGGGG<br>CCTTGACCTCTGGAGTGCACACAT<br>TTCCAGCTGTACTGCAGTCATCTG<br>GACTCTACAGCCTGTCCAGTGTGG<br>TCACCGTACCTTCCTCCAACTTTG<br>GCACTCAAACATATACATGTAACG<br>TGGATCATAAGCCCTCTAACACCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AAGTGGATAAAACTGTGGAGCGTA |
| | | | AGTGTTGTGTCGAGTGTCCTCCTT |
| | | | GTCCTGCTCCTCCTGTGGCAGGC |
| | | | CCATCTGTGTTTCTCTTTCCCCCAA |
| | | | AGCCAAAGGACACTTTGATGATAT |
| | | | CCCGGACCCCTGAGGTGACTTGC |
| | | | GTCGTCGTAGATGTTTCACACGAA |
| | | | GATCCAGAGGTGCAGTTCAACTGG |
| | | | TACGTGGATGGCGTGGAAGTGCA |
| | | | TAATGCCAAGACAAAGCCCCGCGA |
| | | | AGAGCAGTTTAATTCCACCTTCCG |
| | | | CGTGGTGTCTGTGCTGACCGTGG |
| | | | TACATCAGGATTGGCTTAACGGTA |
| | | | AGGAGTACAAGTGCAAGGTGAGTA |
| | | | ACAAGGGGCTGCCCGCCCCTATC |
| | | | GAGAAGACTATCAGTAAAACCAAG |
| | | | GGCCAGCCAAGGGAGCCACAGGT |
| | | | GTACACACTTCCACCATCTAGGGA |
| | | | GGAAATGACAAAGAACCAGGTGA |
| | | | GTTTGACCTGTCTCGTGAAAGGCT |
| | | | TTTATCCCAGTGATATAGCCGTGG |
| | | | AATGGGAAAGTAACGGGCAGCCC |
| | | | GAGAACAACTATAAGACCACACCA |
| | | | CCCATGCTGGACTCCGACGGTTCT |
| | | | TTCTTCCTTTATAGCAAGCTGACA |
| | | | GTGGATAAATCCAGGTGGCAGCA |
| | | | GGGTAACGTATTCAGTTGCAGTGT |
| | | | CATGCACGAGGCACTCCACAACCA |
| | | | CTATACTCAGAAAAGTCTTTCCCT |
| | | | GAGTCCAGGCAAG |
| SEQ ID 2406 | EVQLVQSGGGWQPGG SLRLSCAASGFTFSSYG MHWVRQAPGKGLEWV AFISYDGSNKYYADSVK GRFTISRDNSKNTLYLQ MNSLRAEDTAVYYCATT GDRFQEFDYWGQGTLV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2514 | GAGGTGCAGCTGGTGCAGTCTGG GGGAGGCGTGGTCCAGCCTGGGG GGTCCCTGAGACTCTCCTGTGCAG CGTCTGGATTCACCTTCAGTAGCT ATGGCATGCACTGGGTCCGCCAG GCTCCAGGCAAGGGGCTGGAGTG GGTGGCATTTATATCATATGATGG AAGTAATAAATACTACGCAGACTC CGTGAAGGGCCGATTCACCATCTC CAGAGACAATTCCAAGAACACGCT GTATCTGCAAATGAACAGCCTGAG AGCCGAGGACACGGCCGTATATTA CTGTGCGACAACAGGGGACCGCT TCCAAGAGTTTGACTACTGGGGCC AGGGAACCCTGGTCACCGTCTCCT CAGCAAGCACAAAAGGTCCTTCAG TGTTCCCTCTGGCACCTTGCTCAC GCAGCACCTCTGAGAGTACAGCC GCCCTGGGCTGCCTGGTAAAGGA CTACTTTCCCGAACCAGTCACTGT GTCCTGGAATAGCGGGGCCTTGA CCTCTGGAGTGCACACATTTCCAG CTGTACTGCAGTCATCTGGACTCT ACAGCCTGTCCAGTGTGGTCACC GTACCTTCCTCCAACTTTGGCACT CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG TGTCTGTGCTGACCGTGGTACATC AGGATTGGCTTAACGGTAAGGAGT ACAAGTGCAAGGTGAGTAACAAGG GGCTGCCCGCCCCTATCGAGAAG ACTATCAGTAAAACCAAGGGCCAG CCAAGGGAGCCACAGGTGTACAC ACTTCCACCATCTAGGGAGGAAAT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2407 | QMQLVQSGGVLLQPGR SLRLSCTASGFTFAAYNI NWFRQGPGGGLEWVG FIRANADSGTTEYAASV KGRFFISRDDSRSTAYL QMTSLKTEDTAVYYCAR DDRGRGDDFDYWGQG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2515 | CAGATGCAGCTGGTGCAGTCTGG GGGAGTCTTGCTTCAGCCAGGGC GGTCCCTGAGACTCTCCTGTACAG CTTCTGGATTCACCTTTGCTGCTTA TAATATCAACTGGTTCCGCCAGGG TCCTGGGGGGGGCTGGAGTGG GTAGGTTTCATTAGAGCCAACGCT GATAGTGGGACAACAGAGTACGC CGCGTCTGTGAAAGGCAGATTCTT CATCTCAAGAGATGATTCCAGAAG CACCGCCTACCTGCAAATGACTAG CCTTAAAACCGAGGACACAGCCGT TTATTACTGTGCCAGAGATGATCG GGGTCGGGGAGATGACTTTGACT ACTGGGGCCAGGGCACCCTGGTC ACCGTCTCCTCAGCAAGCACAAAA GGTCCTTCAGTGTTCCCTCTGGCA CCTTGCTCACGCAGCACCTCTGAG AGTACAGCCGCCCTGGGCTGCCT GGTAAAGGACTACTTTCCCGAACC AGTCACTGTGTCCTGGAATAGCGG GGCCTTGACCTCTGGAGTGCACA CATTTCCAGCTGTACTGCAGTCAT CTGGACTCTACAGCCTGTCCAGTG TGGTCACCGTACCTTCCTCCAACT TTGGCACTCAAACATATACATGTAA CGTGGATCATAAGCCCTCTAACAC CAAAGTGGATAAAACTGTGGAGCG TAAGTGTTGTGTCGAGTGTCCTCC TTGTCCTGCTCCTCCTGTGGCAGG CCCATCTGTGTTTCTCTTTCCCCC AAAGCCAAAGGACACTTTGATGAT ATCCCGGACCCCTGAGGTGACTT GCGTCGTCGTAGATGTTTCACACG AAGATCCAGAGGTGCAGTTCAACT GGTACGTGGATGGCGTGGAAGTG CATAATGCCAAGACAAAGCCCCGC GAAGAGCAGTTTAATTCCACCTTC CGCGTGGTGTCTGTGCTGACCGT GGTACATCAGGATTGGCTTAACGG TAAGGAGTACAAGTGCAAGGTGAG TAACAAGGGGCTGCCCGCCCCTA TCGAGAAGACTATCAGTAAAACCA AGGGCCAGCCAAGGGAGCCACAG GTGTACACACTTCCACCATCTAGG GAGGAAATGACAAAGAACCAGGT GAGTTTGACCTGTCTCGTGAAAGG CTTTTATCCCAGTGATATAGCCGT GGAATGGGAAAGTAACGGGCAGC CCGAGAACAACTATAAGACCACAC CACCCATGCTGGACTCCGACGGTT CTTTCTTCCTTTATAGCAAGCTGAC AGTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2408 | QVQLVQSGGGLVQPGG SLRLSCAASGFTFSSYG MTWVRQAPGKGLEWV STISGNGVGTYYPDSVK DRFTISRDSSKNTVYLQ | SEQ ID 2516 | CAGGTGCAGCTGGTGCAATCTGG GGGAGGCTTGGTACAGCCTGGGG GGTCCCTGAGACTCTCCTGTGCAG CCTCTGGATTCACCTTTAGCAGCT ATGGCATGACCTGGGTCCGCCAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | MNSLRAEDTAVYYCVK HGRAGINWYFDLWGRG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | | GCTCCAGGGAAGGGGCTGGAGTG GGTCTCAACTATTAGTGGTAATGG TGTTGGCACATACTACCCAGACTC CGTGAAGGACCGGTTCACCATCTC CAGAGACAGTTCCAAGAACACGGT GTATCTGCAAATGAACAGCCTGAG AGCCGAGGACACGGCCGTATATTA CTGTGTGAAACATGGTAGGGCCG GAATAAACTGGTACTTCGATCTCT GGGGCCGTGGCACCCTGGTGACC GTCTCCTCAGCAAGCACAAAAGGT CCTTCAGTGTTCCCTCTGGCACCT TGCTCACGCAGCACCTCTGAGAGT ACAGCCGCCCTGGGCTGCCTGGT AAAGGACTACTTTCCCGAACCAGT CACTGTGTCCTGGAATAGCGGGG CCTTGACCTCTGGAGTGCACACAT TTCCAGCTGTACTGCAGTCATCTG GACTCTACAGCCTGTCCAGTGTGG TCACCGTACCTTCCTCCAACTTTG GCACTCAAACATATACATGTAACG TGGATCATAAGCCCTCTAACACCA AAGTGGATAAAACTGTGGAGCGTA AGTGTTGTGTCGAGTGTCCTCCTT GTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2409 | QVQLQQSGPGLVKPSQ TLSLTCAISGDSVSSNS AAWNWIRQSPSRGLEW LGRTYYRSKWYNDYAV SVKSRITINPDTSKNQFS LQLNSVTPEDTAVYYCA RGGGLWAFDIWGQGTT VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN | SEQ ID 2517 | CAGGTACAGCTGCAGCAGTCAGG TCCAGGACTGGTGAAGCCCTCGC AGACCCTCTCACTCACCTGTGCCA TCTCCGGGGACAGTGTCTCTAGCA ACAGTGCTGCTTGGAACTGGATCA GGCAGTCCCCATCGAGAGGCCTT GAGTGGCTGGGAAGGACATACTA CAGGTCCAAGTGGTATAATGATTA TGCAGTATCTGTGAAAAGTCGAAT AACCATCAACCCAGACACATCCAA GAACCAGTTCTCCCTGCAGCTGAA CTCTGTGACTCCCGAGGACACGG CTGTGTATTACTGTGCAAGAGGGG GAGGGCTTTGGGCTTTTGATATCT GGGGCCAAGGGACCACGGTCACC GTCTCCTCAGCAAGCACAAAAGGT CCTTCAGTGTTCCCTCTGGCACCT TGCTCACGCAGCACCTCTGAGAGT ACAGCCGCCCTGGGCTGCCTGGT AAAGGACTACTTTCCCGAACCAGT CACTGTGTCCTGGAATAGCGGGG CCTTGACCTCTGGAGTGCACACAT TTCCAGCTGTACTGCAGTCATCTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | GQPENNYKTTPPMLDS DGSFFLYSKLTVDKSRW QQGNVFSCSVMHEALH NHYTQKSLSLSPGK | | GACTCTACAGCCTGTCCAGTGTGG TCACCGTACCTTCCTCCAACTTTG GCACTCAAACATATACATGTAACG TGGATCATAAGCCCTCTAACACCA AAGTGGATAAAACTGTGGAGCGTA AGTGTTGTGTCGAGTGTCCTCCTT GTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2410 | EVQLVQSGAEVKKPGA SVKVSCKASGYTFTGYY MHWRQAPGQGLEWM GWINPNSGGTNYAQKF QGRVTMTRDTSISTAYM ELSRLRSDDTAVYYCAR DKIGSCPYWGQGTLVT VSSASTKGPSVFPLAPC SRSTSESTAALGCLVKD YFPEPVTVSWNSGALTS GVHTFPAVLQSSGLYSL SSVVTVPSSNFGTQTYT CNVDHKPSNTKVDKTV ERKCCVECPPCPAPPV AGPSVFLFPPKPKDTLM ISRTPEVTCVVVDVSHE DPEVQFNWYVDGVEVH NAKTKPREEQFNSTFRV VSVLTVVHQDWLNGKE YKCKVSNKGLPAPIEKTI SKTKGQPREPQVYTLPP SREEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2518 | GAGGTCCAGCTGGTGCAGTCTGG GGCTGAGGTGAAGAAGCCTGGGG CCTCAGTGAAGGTCTCCTGCAAGG CTTCTGGATACACCTTCACCGGCT ACTATATGCACTGGGTGCGACAGG CCCCTGGACAAGGGCTTGAGTGG ATGGGATGGATCAACCCTAACAGT GGTGGCACAAACTATGCACAGAAG TTTCAGGGCAGGGTCACCATGACC AGGGACACGTCCATCAGCACAGC CTACATGGAGCTGAGCAGGCTGA GATCTGACGACACGGCCGTGTATT ACTGTGCGAGAGACAAGATCGGC AGCTGTCCTTACTGGGGCCAGGG AACCCTGGTCACCGTCTCCTCAGC AAGCACAAAAGGTCCTTCAGTGTT CCCTCTGGCACCTTGCTCACGCAG CACCTCTGAGAGTACAGCCGCCCT GGGCTGCCTGGTAAAGGACTACTT TCCCGAACCAGTCACTGTGTCCTG GAATAGCGGGGCCTTGACCTCTG GAGTGCACACATTTCCAGCTGTAC TGCAGTCATCTGGACTCTACAGCC TGTCCAGTGTGGTCACCGTACCTT CCTCCAACTTTGGCACTCAAACAT ATACATGTAACGTGGATCATAAGC CCTCTAACACCAAAGTGGATAAAA CTGTGGAGCGTAAGTGTTGTGTCG AGTGTCCTCCTTGTCCTGCTCCTC CTGTGGCAGGCCCATCTGTGTTTC TCTTTCCCCCAAAGCCAAAGGACA CTTTGATGATATCCCGGACCCCTG AGGTGACTTGCGTCGTCGTAGATG TTTCACACGAAGATCCAGAGGTGC AGTTCAACTGGTACGTGGATGGCG TGGAAGTGCATAATGCCAAGACAA AGCCCCGCGAAGAGCAGTTTAATT CCACCTTCCGCGTGGTGTCTGTGC TGACCGTGGTACATCAGGATTGGC TTAACGGTAAGGAGTACAAGTGCA AGGTGAGTAACAAGGGGCTGCCC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GCCCCTATCGAGAAGACTATCAGT AAAACCAAGGGCCAGCCAAGGGA GCCACAGGTGTACACACTTCCACC ATCTAGGGAGGAAATGACAAAGAA CCAGGTGAGTTTGACCTGTCTCGT GAAAGGCTTTTATCCCAGTGATAT AGCCGTGGAATGGGAAAGTAACG GGCAGCCCGAGAACAACTATAAGA CCACACCACCCATGCTGGACTCC GACGGTTCTTTCTTCCTTTATAGCA AGCTGACAGTGGATAAATCCAGGT GGCAGCAGGGTAACGTATTCAGTT GCAGTGTCATGCACGAGGCACTC CACAACCACTATACTCAGAAAAGT CTTTCCCTGAGTCCAGGCAAG |
| SEQ ID 2411 | QVTLKESGPTLVKPTQT LTLTCTFSGFSLSTSGV GVGWIRQPPGKALEWL ALIYWDDDKRYSPSLKS RLTITKDTSKNQVVLTM TNMDPVDTATYYCAHR PDSSSQCFDYWGQGTL VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | SEQ ID 2519 | CAGGTCACCTTGAAGGAGTCTGGT CCTACGCTGGTGAAACCCACACAG ACCCTCACGCTGACCTGCACCTTC TCTGGGTTCTCACTCAGCACTAGT GGAGTGGGTGTGGGCTGGATCCG TCAGCCCCAGGAAAGGCCCTGG AGTGGCTTGCACTCATTTATTGGG ATGATGATAAGCGCTACAGCCCAT CTCTGAAGAGCAGGCTCACCATCA CCAAGGACACCTCCAAAAACCAGG TGGTCCTTACAATGACCAACATGG ACCCTGTGGACACAGCCACATATT ACTGTGCACACAGACCGGATAGCA GCAGTCAATGTTTTGACTACTGGG GCCAGGGAACCCTGGTCACCGTC TCCTCAGCAAGCACAAAAGGTCCT TCAGTGTTCCCTCTGGCACCTTGC TCACGCAGCACCTCTGAGAGTACA GCCGCCCTGGGCTGCCTGGTAAA GGACTACTTTCCCGAACCAGTCAC TGTGTCCTGGAATAGCGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTTGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2412 | QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK | SEQ ID 2520 | CAGGTCACCTTGAAGGAGTCTGGGGGAGGCGTGGTCCAGCCTGGGAGGTCCCTGAGACTCTCCTGTGCAGCCTCTGGATTCACCTTCAGTAGCTATGCTATGCACTGGGTCCGCCAGGCTCCAGGCAAGGGGCTGGAGTGGGTGGCAGTTATATCATATGATGGAAGTAATAAATACTACGCAGACTCCGTGAAGGGCCGATTCACCATCTCCAGAGACAATTCCAAGAACACGCTGTATCTGCAAATGAACAGCCTGAGAGCTGAGGACACGGCTGTGTATTACTGTGCGAGAAGCAGTGGCTGGTCACTGCCTGAAGACTACTGGGGCCAGGGAACCCTGGTCACCGTCTCCTCAGCAAGCACAAAAGGTCCTTCAGTGTTCCCTCTGGCACCTTGCTCACGCAGCACCTCTGAGAGTACAGCCGCCCTGGGCTGCCTGGTAAAGGACTACTTTCCGAACCAGTCACTGTGTCCTGGAATAGCGGGGCCTTGACCTCTGGAGTGCACACATTTCCAGCTGTACTGCAGTCATCTGGACTCTACAGCCTGTCCAGTGTGGTCACCGTACCTTCCTCCAACTTTGGCACTCAAACATATACATGTAACGTGGATCATAAGCCCTCTAACACCAAAGTGGATAAAACTGTGGAGCGTAAGTGTTGTGTCGAGTGTCCTCCTTGTCCTGCTCCTCCTGTGGCAGGCCCATCTGTGTTTCTCTTTCCCCCAAAGCCAAAGGACACTTTGATGATATCCCGGACCCCTGAGGTGACTTGCGTCGTCGTAGATGTTTCACACGAAGATCCAGAGGTGCAGTTCAACTGGTACGTGGATGGCGTGGAAGTGCATAATGCCAAGACAAAGCCCCGCGAAGAGCAGTTTAATTCCACCTTCCGCGTGGTGTCTGTGCTGACCGTGGTACATCAGGATTGGCTTAACGGTAAGGAGTACAAGTGCAAGGTGAGTAACAAGGGGCTGCCCGCCCCTATCGAGAAGACTATCAGTAAAACCAAGGGCCAGCCAAGGGAGCCACAGGTGTACACACTTCCACCATCTAGGGAGGAAATGACAAAGAACCAGGTGAGTTTGACCTGTCTCGTGAAAGGCTTTTATCCCAGTGATATAGCCGTGGAATGGGAAAGTAACGGGCAGCCCGAGAACAACTATAAGACCACACCACCCATGCTGGACTCCGACGGTTCTTTCTTCCTTTATAGCAAGCTGACAGTGGATAAATCCAGGTGGCAGCAGGGTAACGTATTCAGTTGCAGTGTCATGCACGAGGCACTCCACAACCACTATACTCAGAAAAGTCTTTCCCTGAGTCCAGGCAAG |
| SEQ ID 2413 | QVQLVQSGAEVKKPGASVKVSCKVSGYTLTELSMHVWRQAPGKGLEWMGGFDPEDGETIYAQKFQGRVTMTEDTSTDTAYMELSSLRSEDTAVYYCATDVNPELLGAGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQ | SEQ ID 2521 | CAGGTCCAGCTGGTACAGTCTGGGGCTGAGGTGAAGAAGCCTGGGGCCTCAGTGAAGGTCTCCTGCAAGGTTTCCGGATACACCCTCACTGAATTATCCATGCACTGGGTGCGACAGGCTCCTGGAAAAGGGCTTGAGTGGATGGGAGGTTTTGATCCTGAAGATGGTGAAACAATCTACGCACAGAAGTTCCAGGGCAGAGTCACCATGACCGAGGACACATCTACAGACACAGCCTACATGGAGCTGAGCAGCCTGAGATCTGAGGACACGGCCGTGTATTACTGTGCAACGGATGTGAACCCGTGAGCTACTGGGGCCAGGGCACCCTGGTCACCGTCTCCTCAGCAAGCACAAAGGTCCTTCAGTGTTCCCTCTGGCACCTTGCTCACGCAGCACCTCTG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | FNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK | | AGAGTACAGCCGCCCTGGGCTGCCTGGTAAAGGACTACTTTCCCGAACCAGTCACTGTGTCCTGGAATAGCGGGGCCTTGACCTCTGGAGTGCACACATTTCCAGCTGTACTGCAGTCATCTGGACTCTACAGCCTGTCCAGTGTGGTCACCGTACCTTCCTCCAACTTTGGCACTCAAACATATACATGTAACGTGGATCATAAGCCCTCTAACACCAAAGTGGATAAAACTGTGGAGCGTAAGTGTTGTGTCGAGTGTCCTCCTTGTCCTGCTCCTCCTGTGGCAGGCCCATCTGTGTTTCTCTTTCCCCCAAAGCCAAAGGACACTTTGATGATATCCCGGACCCCTGAGGTGACTTGCGTCGTCGTAGATGTTTCACACGAAGATCCAGAGGTGCAGTTCAACTGGTACGTGGATGGCGTGGAAGTGCATAATGCCAAGACAAAGCCCCGCGAAGAGCAGTTTAATTCCACCTTCCGCGTGGTGTCTGTGCTGACCGTGGTACATCAGGATTGGCTTAACGGTAAGGAGTACAAGTGCAAGGTGAGTAACAAGGGGCTGCCCGCCCCTATCGAGAAGACTATCAGTAAAACCAAGGGCCAGCCAAGGGAGCCACAGGTGTACACACTTCCACCATCTAGGGAGGAAATGACAAAGAACCAGGTGAGTTTGACCTGTCTCGTGAAAGGCTTTTATCCCAGTGATATAGCCGTGGAATGGGAAAGTAACGGGCAGCCCGAGAACAACTATAAGACCACACCACCCATGCTGGACTCCGACGGTTCTTTCTTCCTTTATAGCAAGCTGACAGTGGATAAATCCAGGTGGCAGCAGGGTAACGTATTCAGTTGCAGTGTCATGCACGAGGCACTCCACAACCACTATACTCAGAAAAGTCTTTCCCTGAGTCCAGGCAAG |
| SEQ ID 2414 | QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK | SEQ ID 2522 | CAGGTCACCTTGAAGGAGTCTGGGGGAGGCTTGGTCCAGCCTGGAGGGTCCCTGAGACTCTCCTGTGCAGCCTCTGGATTCACCTTCAGTGACCAGTACATGGACTGGGTCCGCCAGGCTCCAGGGAAGGGGCTGGAGTGGGTTGGCCGTGTTAGAAACAAAGCTAACAGTTACACCACAGAATACGCCGCGTCTGTGAAAGGCAGATTCACCATCTCAAGAGATGATTCAAAGAACTCACTGTATCTGCAAATGAATAGTCTGAACACCGAGGACACGGCCATGTATTTCTGTGCTAGTAGTCTCAATAGTGGGGGCTACCGATGCTTCCATCACTGGGGCCAGGGCACCCTGGTGACCGTCTCCTCAGCAAGCACAAAGGGCCTTCAGTGTTCCCTCTGGCACCTTGCTCACGCAGCACCTCTGAGAGTACAGCCGCCCTGGGCTGCCTGGTAAAGGACTACTTTCCCGAACCAGTCACTGTGTCCTGGAATAGCGGGGCCTTGACCTCTGGAGTGCACACATTTCCAGCTGTACTGCAGTCATCTGGACTCTACAGCCTGTCCAGTGTGGTCACCGTACCTTCCTCCAACTTTGGCACTCAAACATATACATGTAACGTGGATCATAAGCCCTCTAACACCAAAGTGGATAAAACTGTGGAGCGTAAGTGTTGTGTCGAGTGTCCTCCTTGTCCTGCTCCTCCTGTGGCAGGCCCATCTGTGTTTCTCTTTCCCCCAAAGCCAAAGGACACTTTGATGATATCCCGGACCCCTGAGGTGACTTGCGTCGTCGTAGATGTTTCACACGAAGATCCAGAGGTGCAGTTCAACTGGTACGTGGATGGCGTGGAAGT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GCATAATGCCAAGACAAAGCCCCG CGAAGAGCAGTTTAATTCCACCTT CCGCGTGGTGTCTGTGCTGACCG TGGTACATCAGGATTGGCTTAACG GTAAGGAGTACAAGTGCAAGGTGA GTAACAAGGGGCTGCCCGCCCCT ATCGAGAAGACTATCAGTAAAACC AAGGGCCAGCCAAGGGAGCCACA GGTGTACACACTTCCACCATCTAG GGAGGAAATGACAAAGAACCAGG TGAGTTTGACCTGTCTCGTGAAAG GCTTTTATCCCAGTGATATAGCCG TGGAATGGGAAAGTAACGGGCAG CCCGAGAACAACTATAAGACCACA CCACCCATGCTGGACTCCGACGG TTCTTTCTTCCTTTATAGCAAGCTG ACAGTGGATAAATCCAGGTGGCAG CAGGGTAACGTATTCAGTTGCAGT GTCATGCACGAGGCACTCCACAAC CACTATACTCAGAAAAGTCTTTCC CTGAGTCCAGGCAAG |
| SEQ ID 2415 | QVQLVQSGGGLVQPGG SLRLSCSASGFTFSSYA MHWVRQAPGKGLEYVS AISSNGGSTYYADSVKG RFTISRDNSKNTLYLQM SSLRAEDTAVYYCVKAP RGVVPAAMRGGYWGQ GTLVTVSSASTKGPSVF PLAPCSRSTSESTAALG CLVKDYFPEPVTVSWN SGALTSGVHTFPAVLQS SGLYSLSSVVTVPSSNF GTQTYTCNVDHKPSNT KVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2523 | CAGGTCCAGCTGGTGCAGTCTGG GGGAGGCTTGGTCCAGCCTGGGG GGTCCCTGAGACTCTCCTGTTCAG CCTCTGGATTCACCTTCAGTAGCT ATGCTATGCACTGGGTCCGCCAG GCTCCAGGGAAGGGACTGGAATA TGTTTCAGCTATTAGTAGTAATGG GGGTAGCACATACTACGCAGACTC AGTGAAGGGCAGATTCACCATCTC CAGAGACAATTCCAAGAACACGCT GTATCTTCAAATGAGCAGTCTGAG AGCTGAGGACACGGCTGTGTATTA CTGTGTGAAAGCGCCGAGGGGTG TAGTACCAGCTGCTATGCGGGGG GGCTACTGGGGCCAGGGAACCCT GGTCACCGTCTCCTCAGCAAGCAC AAAAGGTCCTTCAGTGTTCCCTCT GGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGTCATGCACGAGGCACTCCACA<br>ACCACTATACTCAGAAAAGTCTTTC<br>CCTGAGTCCAGGCAAG |
| SEQ ID<br>2416 | QVQLQESGGGLVQPGR<br>SLRLSCTASGFTFGDYA<br>MSWFRQAPGKGLEWV<br>GFIRSKAYGGTTEYAAS<br>VKGRFTISRDDSKSIAYL<br>QMNSLKTEDTAVYYCT<br>RLVGNSGSYYPFGYWG<br>QGTLVTVSSASTKGPSV<br>FPLAPCSRSTSESTAAL<br>GCLVKDYFPEPVTVSW<br>NSGALTSGVHTFPAVLQ<br>SSGLYSLSSVVTVPSSN<br>FGTQTYTCNVDHKPSN<br>TKVDKTVERKCCVECPP<br>CPAPPVAGPSVFLFPPK<br>PKDTLMISRTPEVTCVV<br>VDVSHEDPEVQFNWYV<br>DGVEVHNAKTKPREEQ<br>FNSTFRVVSVLTVVHQD<br>WLNGKEYKCKVSNKGL<br>PAPIEKTISKTKGQPREP<br>QVYTLPPSREEMTKNQ<br>VSLTCLVKGFYPSDIAVE<br>WESNGQPENNYKTTPP<br>MLDSDGSFFLYSKLTVD<br>KSRWQQGNVFSCSVM<br>HEALHNHYTQKSLSLSP<br>GK | SEQ ID<br>2524 | CAGGTGCAGCTGCAGGAGTCGGG<br>GGGAGGCTTGGTACAGCCAGGGC<br>GGTCCCTGAGACTCTCCTGTACAG<br>CTTCTGGATTCACCTTTGGTGATTA<br>TGCTATGAGCTGGTTCCGCCAGG<br>CTCCAGGGAAGGGGCTGGAGTGG<br>GTAGGTTTCATTAGAAGCAAAGCT<br>TATGGTGGGACAACAGAATACGCC<br>GCGTCTGTGAAAGGCAGATTCACC<br>ATCTCAAGAGATGATTCCAAAAGC<br>ATCGCCTATCTGCAAATGAACAGC<br>CTGAAAACCGAGGACACAGCCGT<br>GTATTACTGTACTAGATTGGTGG<br>CAATAGTGGGAGCTACTATCCGTT<br>TGGGTACTGGGGCCAGGGAACCC<br>TGGTGACCGTCTCCTCAGCAAGCA<br>CAAAAGGTCCTTCAGTGTTCCCTC<br>TGGCACCTTGCTCACGCAGCACCT<br>CTGAGAGTACAGCCGCCCTGGGC<br>TGCCTGGTAAAGGACTACTTTCCC<br>GAACCAGTCACTGTGTCCTGGAAT<br>AGCGGGGCCTTGACCTCTGGAGT<br>GCACACATTTCCAGCTGTACTGCA<br>GTCATCTGGACTCTACAGCCTGTC<br>CAGTGTGGTCACCGTACCTTCCTC<br>CAACTTTGGCACTCAAACATATAC<br>ATGTAACGTGGATCATAAGCCCTC<br>TAACACCAAAGTGGATAAAACTGT<br>GGAGCGTAAGTGTTGTGTCGAGT<br>GTCCTCCTTGTCCTGCTCCTCCTG<br>TGGCAGGCCCATCTGTGTTTCTCT<br>TTCCCCCAAAGCCAAAGGACACTT<br>TGATGATATCCCGGACCCCTGAGG<br>TGACTTGCGTCGTCGTAGATGTTT<br>CACACGAAGATCCAGAGGTGCAG<br>TTCAACTGGTACGTGGATGGCGTG<br>GAAGTGCATAATGCCAAGACAAAG<br>CCCCGCGAAGAGCAGTTTAATTCC<br>ACCTTCCGCGTGGTGTCTGTGCTG<br>ACCGTGGTACATCAGGATTGGCTT<br>AACGGTAAGGAGTACAAGTGCAAG<br>GTGAGTAACAAGGGGCTGCCCGC<br>CCCTATCGAGAAGACTATCAGTAA<br>AACCAAGGGCCAGCCAAGGGAGC<br>CACAGGTGTACACACTTCCACCAT<br>CTAGGGAGGAAATGACAAAGAACC<br>AGGTGAGTTTGACCTGTCTCGTGA<br>AAGGCTTTTATCCCAGTGATATAG<br>CCGTGGAATGGGAAAGTAACGGG<br>CAGCCCGAGAACAACTATAAGACC<br>ACACCACCCATGCTGGACTCCGAC<br>GGTTCTTTCTTCCTTTATAGCAAGC<br>TGACAGTGGATAAATCCAGGTGGC<br>AGCAGGGTAACGTATTCAGTTGCA<br>GTGTCATGCACGAGGCACTCCACA<br>ACCACTATACTCAGAAAAGTCTTTC<br>CCTGAGTCCAGGCAAG |
| SEQ ID<br>2417 | QVQLQQWGAGLLKPSE<br>TLSLTCAVYGGSFSGYY<br>WSWIRQPPGKGLEWIG<br>EINHSGSTNYNPSLKSR<br>VTISVDTSKNQFSLKLSS<br>VTAADTAVYYCARGRSL<br>PYRGLAPRSFGGYYFD<br>YWGQGTLVTVSSASTK<br>GPSVFPLAPCSRSTSES<br>TAALGCLVKDYFPEPVT<br>VSWNSGALTSGVHTFP<br>AVLQSSGLYSLSSVVTV<br>PSSNFGTQTYTCNVDH<br>KPSNTKVDKTVERKCCV | SEQ ID<br>2525 | CAGGTGCAGCTACAGCAGTGGGG<br>CGCAGGACTGTTGAAGCCTTCGG<br>AGACCCTGTCCCTCACCTGCGCTG<br>TCTATGGTGGGTCCTTCAGTGGTT<br>ACTACTGGAGCTGGATCCGCCAG<br>CCCCCAGGGAAGGGGCTGGAGTG<br>GATTGGGGAAATCAATCATAGTGG<br>AAGCACCAACTACAACCCGTCCCT<br>CAAGAGTCGAGTCACCATATCAGT<br>AGACACGTCCAAGAACCAGTTCTC<br>CCTGAAGCTGAGCTCGGTGACCG<br>CCGCGGACACGGCTGTGTATTACT<br>GTGCGAGAGGCCGGTCCCTTCCC<br>TACCGGGGGTTGGCTCCTAGATCT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | ECPPCPAPPVAGPSVFL FPPKPKDTLMISRTPEV TCVVVDVSHEDPEVQF NWYVDGVEVHNAKTKP REEQFNSTFRVVSVLTV VHQDWLNGKEYKCKVS NKGLPAPIEKTISKTKGQ PREPQVYTLPPSREEMT KNQVSLTCLVKGFYPSD IAVEWESNGQPENNYK TTPPMLDSDGSFFLYSK LTVDKSRWQQGNVFSC SVMHEALHNHYTQKSL SLSPGK | | TTCGGAGGATACTACTTTGACTAC TGGGGCCAGGGAACCCTGGTCAC CGTCTCCTCAGCAAGCACAAAAGG TCCTTCAGTGTTCCCTCTGGCACC TTGCTCACGCAGCACCTCTGAGAG TACAGCCGCCCTGGGCTGCCTGG TAAAGGACTACTTTCCCGAACCAG TCACTGTGTCCTGGAATAGCGGG GCCTTGACCTCTGGAGTGCACACA TTTCCAGCTGTACTGCAGTCATCT GGACTCTACAGCCTGTCCAGTGTG GTCACCGTACCTTCCTCCAACTTT GGCACTCAAACATATACATGTAAC GTGGATCATAAGCCCTCTAACACC AAAGTGGATAAAACTGTGGAGCGT AAGTGTTGTGTCGAGTGTCCTCCT TGTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2418 | QVQLQESGGGLVRPGG SLRLSCGDSGFNFSGY EMNWVRQAPGKGLEW VSYVSTSGSTRYYADSV KGRFTISRDNAKNTLYL QMNSLRVEDTAVYYCA RGRTHWGPQDFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2526 | CAGGTGCAGCTGCAGGAGTCGGG GGGAGGCTTGGTACGGCCTGGAG GGTCCCTGAGACTCTCCTGTGGA GACTCTGGATTCAACTTCAGTGGA TATGAAATGAACTGGGTCCGCCAG GCTCCAGGGAAGGGGCTGGAGTG GGTTTCATACGTCAGTACTAGTGG TAGTACCAGATACTACGCAGACTC TGTGAAGGGCCGATTCACCATCTC CAGAGACAACGCCAAGAACACCCT GTATTTGCAAATGAACAGTCTGAG AGTCGAGGACACGGCTGTGTATTA CTGTGCAAGAGGACGGACTCACT GGGGCCCCCAGGACTTTGACTAC TGGGGCCAGGGAACCCTGGTCAC CGTCTCCTCAGCAAGCACAAAAGG TCCTTCAGTGTTCCCTCTGGCACC TTGCTCACGCAGCACCTCTGAGAG TACAGCCGCCCTGGGCTGCCTGG TAAAGGACTACTTTCCCGAACCAG TCACTGTGTCCTGGAATAGCGGG GCCTTGACCTCTGGAGTGCACACA TTTCCAGCTGTACTGCAGTCATCT GGACTCTACAGCCTGTCCAGTGTG GTCACCGTACCTTCCTCCAACTTT GGCACTCAAACATATACATGTAAC GTGGATCATAAGCCCTCTAACACC AAAGTGGATAAAACTGTGGAGCGT AAGTGTTGTGTCGAGTGTCCTCCT TGTCCTGCTCCTCCTGTGGCAGGC CCATCTGTGTTTCTCTTTCCCCCAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2419 | QVQLQESGGGLVQPGG SLRLSCAASGFTFSSYA MSWVRQAPGKGLEWV SAISGSGGSTYYADSVK GRFTISRDNSKNTLYLQ MNSLRAEDTAVYYCAK GGMYYYGSGSSYFDY WGQGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2527 | CAGGTGCAGCTGCAGGAGTCGGG GGGAGGCTTGGTACAGCCTGGGG GGTCCCTGAGACTCTCCTGTGCAG CCTCTGGATTCACCTTTAGCAGCT ATGCCATGAGCTGGGTCCGCCAG GCTCCAGGGAAGGGGCTGGAGTG GGTCTCAGCTATTAGTGGTAGTGG TGGTAGCACATACTACGCAGACTC CGTGAAGGGCCGGTTCACCATCT CCAGAGACAATTCCAAGAACACGC TGTATCTGCAAATGAACAGCCTGA GAGCCGAGGACACGGCCGTATAT TACTGTGCGAAGGAGGAATGTAT TACTATGGTTCGGGGAGCTCGTAC TTTGACTACTGGGGCCAGGGAAC CCTGGTGACCGTCTCCTCAGCAAG CACAAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2420 | QVQLVQSGGGLVQPGG SLRLSCAASGFTFSSYA MSWVRQAPGKGLEWV SGISGSGGSTYYADSVK GRFTISRDNSKNMLFLQ MNSPRAEDTAVYYCAK KIAAAGKQPVDYWGQG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2528 | CAGGTGCAGCTGGTGCAATCTGG GGGAGGCTTGGTACAGCCTGGGG GGTCCCTGAGACTCTCCTGTGCAG CCTCTGGATTCACCTTTAGCAGCT ATGCCATGAGCTGGGTCCGCCAG GCTCCAGGGAAGGGGCTGGAATG GGTCTCAGGTATTAGTGGTAGTGG TGGTAGCACATACTACGCAGACTC CGTGAAGGGCCGGTTCACCATCT CCAGAGACAATTCCAAGAACATGC TGTTTCTGCAAATGAACAGCCCGA GAGCCGAGGACACGGCCGTATAT TACTGTGCGAAGAAAATAGCAGCA GCTGGTAAGCAACCTGTTGACTAC TGGGGCCAGGGAACCCTGGTCAC CGTCTCCTCAGCAAGCACAAAAGG TCCTTCAGTGTTCCCTCTGGCACC TTGCTCACGCAGCACCTCTGAGAG TACAGCCGCCCTGGGCTGCCTGG TAAAGGACTACTTTCCCGAACCAG TCACTGTGTCCTGGAATAGCGGG GCCTTGACCTCTGGAGTGCACACA TTTCCAGCTGTACTGCAGTCATCT GGACTCTACAGCCTGTCCAGTGTG GTCACCGTACCTTCCTCCAACTTT GGCACTCAAACATATACATGTAAC GTGGATCATAAGCCCTCTAACACC AAAGTGGATAAAACTGTGGAGCGT AAGTGTTGTGTCGAGTGTCCTCCT TGTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2421 | QVQLQQWGAGLLKPSE TLSLTCAVYGGSFSGYY WSWIRQPPGKGLEWIG EINHSGSTNYNPSLKSR VTISVDTSKNQFSLKLSS VTAADTAVYYCARRKVY DYVWGSYRLPGSVSYY FDYWGQGTLVTVSSAS TKGPSVFPLAPCSRSTS | SEQ ID 2529 | CAGGTGCAGCTACAGCAGTGGGG CGCAGGACTGTTGAAGCCTTCGG AGACCCTGTCCCTCACCTGCGCTG TCTATGGTGGGTCCTTCAGTGGTT ACTACTGGAGCTGGATCCGCCAG CCCCCAGGGAAGGGGCTGGAGTG GATTGGGGAAATCAATCATAGTGG AAGCACCAACTACAACCCGTCCCT CAAGAGTCGAGTCACCATATCAGT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | ESTAALGCLVKDYFPEP VTVSWNSGALTSGVHT FPAVLQSSGLYSLSSVV TVPSSNFGTQTYTCNVD HKPSNTKVDKTVERKC CVECPPCPAPPVAGPS VFLFPPKPKDTLMISRTP EVTCVVVDVSHEDPEV QFNWYVDGVEVHNAKT KPREEQFNSTFRVVSVL TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | | AGACACGTCCAAGAACCAGTTCTC CCTGAAGCTGAGCTCTGTGACCG CCGCGGACACGGCTGTGTATTACT GTGCGAGAAGGAAGGTGTATGATT ACGTTTGGGGGAGTTATCGCCTCC CCGGGTCGGTATCGTACTACTTTG ACTACTGGGGCCAGGGAACCCTG GTCACCGTCTCCTCAGCAAGCACA AAAGGTCCTTCAGTGTTCCCTCTG GCACCTTGCTCACGCAGCACCTCT GAGAGTACAGCCGCCCTGGGCTG CCTGGTAAAGGACTACTTTCCCGA ACCAGTCACTGTGTCCTGGAATAG CGGGGCCTTGACCTCTGGAGTGC ACACATTTCCAGCTGTACTGCAGT CATCTGGACTCTACAGCCTGTCCA GTGTGGTCACCGTACCTTCCTCCA ACTTTGGCACTCAAACATATACAT GTAACGTGGATCATAAGCCCTCTA ACACCAAAGTGGATAAAACTGTGG AGCGTAAGTGTTGTGTCGAGTGTC CTCCTTGTCCTGCTCCTCCTGTGG CAGGCCCATCTGTGTTTCTCTTTC CCCCAAAGCCAAAGGACACTTTGA TGATATCCCGGACCCCTGAGGTGA CTTGCGTCGTCGTAGATGTTTCAC ACGAAGATCCAGAGGTGCAGTTCA ACTGGTACGTGGATGGCGTGGAA GTGCATAATGCCAAGACAAAGCCC CGCGAAGAGCAGTTTAATTCCACC TTCCGCGTGGTGTCTGTGCTGACC GTGGTACATCAGGATTGGCTTAAC GGTAAGGAGTACAAGTGCAAGGT GAGTAACAAGGGGCTGCCCGCCC CTATCGAGAAGACTATCAGTAAAA CCAAGGGCCAGCCAAGGGAGCCA CAGGTGTACACACTTCCACCATCT AGGGAGGAAATGACAAAGAACCA GGTGAGTTTGACCTGTCTCGTGAA AGGCTTTTATCCCAGTGATATAGC CGTGGAATGGGAAAGTAACGGGC AGCCCGAGAACAACTATAAGACCA CACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2422 | QVQLVQSGAEVKKPGE SLKISCKGSGYSFTSYW IGWVRQMPGKGLEWM GIIYPGDSDTRYSPSFQ GQVTISADKSISTAYLQ WSSLKASDTAMYYCAR LPGRAARPDYWGQGTL VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS | SEQ ID 2530 | CAGGTCCAGCTGGTACAGTCTGG AGCAGAGGTGAAAAGCCCGGGG AGTCTCTGAAGATCTCCTGTAAGG GTTCTGGATACAGCTTTACCAGCT ACTGGATCGGCTGGGTGCGCCAG ATGCCCGGGAAAGGCCTGGAGTG GATGGGGATCATCTATCCTGGTGA CTCTGATACCAGATACAGCCCGTC CTTCCAAGGCCAGGTCACCATCTC AGCCGACAAGTCCATCAGCACCG CCTACCTGCAGTGGAGCAGCCTG AAGGCCTCGGACACCGCCATGTAT TACTGTGCGAGACTCCCGGGAG AGCAGCTCGTCCAGACTACTGGG GCCAGGGCACCCTGGTCACCGTC TCCTCAGCAAGCACAAAAGGTCCT TCAGTGTTCCCTCTGGCACCTTGC TCACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | DGSFFLYSKLTVDKSRW QQGNVFSCSVMHEALH NHYTQKSLSLSPGK | | CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2423 | QVTLKESGGGVVQPGR SLRLSCAASGFTFSSYA MHWVRQAPGKGLEWV AVISYDGSNKYYADSVK GRFTISRDNSKNTLYLQ MNSLRAEDTAVYYCAR GPGAVAGTKPKYYFDY WGQGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2531 | CAGGTCACCTTGAAGGAGTCTGG GGGAGGCGTGGTCCAGCCTGGGA GGTCCCTGAGACTCTCCTGTGCAG CCTCTGGATTCACCTTCAGTAGCT ATGCTATGCACTGGGTCCGCCAG GCTCCAGGCAAGGGGCTGGAGTG GGTGGCAGTTATATCATATGATGG AAGTAATAAATACTACGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAGAGGCCCCGGGGCAG TGGCTGGTACTAAGCCAAAGTACT ACTTTGACTACTGGGGCCAGGGAA CCCTGGTCACCGTCTCCTCAGCAA GCACAAAAGGTCCTTCAGTGTTCC CTCTGGCACCTTGCTCACGCAGCA CCTCTGAGAGTACAGCCGCCCTG GGCTGCCTGGTAAAGGACTACTTT CCCGAACCAGTCACTGTGTCCTGG AATAGCGGGGCCTTGACCTCTGG AGTGCACACATTTCCAGCTGTACT GCAGTCATCTGGACTCTACAGCCT GTCCAGTGTGGTCACCGTACCTTC CTCCAACTTTGGCACTCAAACATA TACATGTAACGTGGATCATAAGCC CTCTAACACCAAAGTGGATAAAAC TGTGGAGCGTAAGTGTTGTGTCGA GTGTCCTCCTTGTCCTGCTCCTCC TGTGGCAGGCCCATCTGTGTTTCT CTTTCCCCCAAAGCCAAAGGACAC TTTGATGATATCCCGGACCCCTGA GGTGACTTGCGTCGTCGTAGATGT TTCACACGAAGATCCAGAGGTGCA GTTCAACTGGTACGTGGATGGCGT GGAAGTGCATAATGCCAAGACAAA GCCCCGCGAAGAGCAGTTTAATTC CACCTTCCGCGTGGTGTCTGTGCT GACCGTGGTACATCAGGATTGGCT TAACGGTAAGGAGTACAAGTGCAA GGTGAGTAACAAGGGGCTGCCCG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CCCCTATCGAGAAGACTATCAGTA AAACCAAGGGCCAGCCAAGGGAG CCACAGGTGTACACACTTCCACCA TCTAGGGAGGAAATGACAAAGAAC CAGGTGAGTTTGACCTGTCTCGTG AAAGGCTTTTATCCCAGTGATATA GCCGTGGAATGGGAAAGTAACGG GCAGCCCGAGAACAACTATAAGAC CACACCACCCATGCTGGACTCCGA CGGTTCTTTCTTCCTTTATAGCAAG CTGACAGTGGATAAATCCAGGTGG CAGCAGGGTAACGTATTCAGTTGC AGTGTCATGCACGAGGCACTCCAC AACCACTATACTCAGAAAAGTCTTT CCCTGAGTCCAGGCAAG |
| SEQ ID 2424 | EVQLVQSGGGVVQPGR SLRLSCAASGFTFSSYA MHWVRQAPGKGLEWV AVISYDGSNKYYADSVK GRFTISRDNSKNTLYLQ MNSLRAEDTAVYYCAR ATYYYDSSGYRFDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2532 | GAGGTCCAGCTGGTGCAGTCTGG GGGAGGCGTGGTCCAGCCTGGGA GGTCCCTGAGACTCTCCTGTGCAG CCTCTGGATTCACCTTCAGTAGCT ATGCTATGCACTGGGTCCGCCAG GCTCCAGGCAAGGGGCTGGAGTG GGTGGCAGTTATATCATATGATGG AAGTAATAAATACTACGCAGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAGGGCCACGTATTACTA TGATAGTAGTGGTTATAGGTTTGA CTACTGGGGCCAGGGAACCCTGG TCACCGTCTCCTCAGCAAGCACAA AAGGTCCTTCAGTGTTCCCTCTGG CACCTTGCTCACGCAGCACCTCTG AGAGTACAGCCGCCCTGGGCTGC CTGGTAAAGGACTACTTTCCCGAA CCAGTCACTGTGTCCTGGAATAGC GGGGCCTTGACCTCTGGAGTGCA CACATTTCCAGCTGTACTGCAGTC ATCTGGACTCTACAGCCTGTCCAG TGTGGTCACCGTACCTTCCTCCAA CTTTGGCACTCAAACATATACATGT AACGTGGATCATAAGCCCTCTAAC ACCAAAGTGGATAAAACTGTGGAG CGTAAGTGTTGTGTCGAGTGTCCT CCTTGTCCTGCTCCTCCTGTGGCA GGCCCATCTGTGTTTCTCTTTCCC CCAAAGCCAAAGGACACTTTGATG ATATCCCGGACCCCTGAGGTGACT TGCGTCGTCGTAGATGTTTCACAC GAAGATCCAGAGGTGCAGTTCAAC TGGTACGTGGATGGCGTGGAAGT GCATAATGCCAAGACAAAGCCCCG CGAAGAGCAGTTTAATTCCACCTT CCGCGTGGTGTCTGTGCTGACCG TGGTACATCAGGATTGGCTTAACG GTAAGGAGTACAAGTGCAAGGTGA GTAACAAGGGGCTGCCCGCCCCT ATCGAGAAGACTATCAGTAAAACC AAGGGCCAGCCAAGGGAGCCACA GGTGTACACACTTCCACCATCTAG GGAGGAAATGACAAAGAACCAGG TGAGTTTGACCTGTCTCGTGAAAG GCTTTTATCCCAGTGATATAGCCG TGGAATGGGAAAGTAACGGGCAG CCCGAGAACAACTATAAGACCACA CCACCCATGCTGGACTCCGACGG TTCTTTCTTCCTTTATAGCAAGCTG ACAGTGGATAAATCCAGGTGGCAG CAGGGTAACGTATTCAGTTGCAGT GTCATGCACGAGGCACTCCACAAC CACTATACTCAGAAAAGTCTTTCC CTGAGTCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2425 | EVQLVQSGGGLVEPGG SLRLSCAASRFTFSDAW MSWVRQAPGKGLEWV GRIKSKISGGTTDYAAP VQGRFTISRDDSKNTLY LQMDSLKTEDTAVYYCA NRNLGYWGQGTLVTVS SASTKGPSVFPLAPCSR STSESTAALGCLVKDYF PEPVTVSWNSGALTSG VHTFPAVLQSSGLYSLS SVVTVPSSNFGTQTYTC NVDHKPSNTKVDKTVE RKCCVECPPCPAPPVA GPSVFLFPPKPKDTLMI SRTPEVTCVVVDVSHED PEVQFNWYVDGVEVHN AKTKPREEQFNSTFRVV SVLTVVHQDWLNGKEY KCKVSNKGLPAPIEKTIS KTKGQPREPQVYTLPPS REEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | SEQ ID 2533 | GAGGTCCAGCTGGTACAGTCTGG GGGAGGCTTGGTAGAACCGGGGG GGTCCCTTAGACTCTCCTGTGCAG CCTCTCGATTCACTTTCAGTGACG CCTGGATGAGCTGGGTCCGCCAG GCTCCAGGTAAGGGGCTGGAGTG GGTTGGCCGTATTAAAAGCAAAT AAGTGGTGGGACAACAGACTACG CTGCACCCGTGCAAGGCAGATTCA CCATCTCAAGAGATGATTCAAAAA ACACGCTGTATCTGCAAATGGACA GCCTGAAAACCGAGGACACAGCC GTGTATTACTGTGCGAACCGAAAC TTAGGCTACTGGGGCCAGGGCAC CCTGGTGACCGTCTCCTCAGCAAG CACAAAAGGTCCTTCAGTGTTCCC TCTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2426 | EVQLVQSGAEVKKPGA SVKVSCKASGYTFTSYA MHWVRQAPGQRLEWM GWINAGNGNTKYSQKF QGRVTMTTDTSTSTAY MELRSLRSDDTAVYYCA RARYYDSSGYIAPSGYF DYWGQGTLVTVSSAST KGPSVFPLAPCSRSTSE STAALGCLVKDYFPEPV TVSWNSGALTSGVHTF PAVLQSSGLYSLSSVVT VPSSNFGTQTYTCNVD HKPSNTKVDKTVERKC CVECPPCPAPPVAGPS VFLFPPKPKDTLMISRTP EVTCVVVDVSHEDPEV QFNWYVDGVEVHNAKT KPREEQFNSTFRVVSVL | SEQ ID 2534 | GAGGTCCAGCTGGTGCAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGAGTG GATGGGATGGATCAACGCTGGCA ATGGTAACACAAAATATTCACAGA AGTTCCAGGGCAGAGTCACCATGA CCACAGACACATCCACGAGCACA GCCTACATGGAGCTGAGGAGCCT GAGATCTGACGACACGGCCGTGT ATTACTGTGCGAGAGCTCGTTACT ATGATAGTAGTGGTTATATTGCCA GCGGGTACTTTGACTACTGGG GCCAGGGAACCCTGGTCACCGTC TCCTCAGCAAGCACAAAAGGTCCT TCAGTGTTCCCTCTGGCACCTTGC TCACGCAGCACCTCTGAGAGTACA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | | GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2427 | QVQLVQSGAEVKKPGA SVKVSCKASGYTFTSYA MHWRQAPGQRLEWM GWINAGNGNTKYSQKF QGRVTITRDTSASTAYM ELSSLRSEDTAVYYCAR DGPAVDGAEYFQHWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2535 | CAGGTGCAGCTGGTGCAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGAGTG GATGGGATGGATCAACGCTGGCA ATGGTAACACAAAATATTCACAGA AGTTCCAGGGCAGAGTCACCATTA CCAGGGACACATCCGCGAGCACA GCCTACATGGAGCTGAGCAGCCT GAGATCTGAAGACACGGCTGTGTA TTACTGTGCGAGAGATGGCCCCG CCGTTGATGGTGCTGAATACTTCC AGCACTGGGGCCAGGGCACCCTG GTCACCGTCTCCTCAGCAAGCACA AAAGGTCCTTCAGTGTTCCTCTG GCACCTTGCTCACGCAGCACCTCT GAGAGTACAGCGCCCTGGGCTG CCTGGTAAAGGACTACTTTCCCGA ACCAGTCACTGTGTCCTGGAATAG CGGGGCCTTGACCTCTGGAGTGC ACACATTTCCAGCTGTACTGCAGT CATCTGGACTCTACAGCCTGTCCA GTGTGGTCACCGTACCTTCCTCCA ACTTTGGCACTCAAACATATACAT GTAACGTGGATCATAAGCCCTCTA ACACCAAAGTGGATAAAACTGTGG AGCGTAAGTGTTGTGTCGAGTGTC CTCCTTGTCCTGCTCCTCCTGTGG CAGGCCCATCTGTGTTTCTCTTTC CCCAAAGCCAAAGGACACTTTGA TGATATCCCGGACCCCTGAGGTGA CTTGCGTCGTCGTAGATGTTTCAC ACGAAGATCCAGAGGTGCAGTTCA ACTGGTACGTGGATGGCGTGGAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGCATAATGCCAAGACAAAGCCC |
| | | | CGCGAAGAGCAGTTTAATTCCACC |
| | | | TTCCGCGTGGTGTCTGTGCTGACC |
| | | | GTGGTACATCAGGATTGGCTTAAC |
| | | | GGTAAGGAGTACAAGTGCAAGGT |
| | | | GAGTAACAAGGGGCTGCCCGCCC |
| | | | CTATCGAGAAGACTATCAGTAAAA |
| | | | CCAAGGGCCAGCCAAGGGAGCCA |
| | | | CAGGTGTACACACTTCCACCATCT |
| | | | AGGGAGGAAATGACAAAGAACCA |
| | | | GGTGAGTTTGACCTGTCTCGTGAA |
| | | | AGGCTTTTATCCCAGTGATATAGC |
| | | | CGTGGAATGGGAAAGTAACGGGC |
| | | | AGCCCGAGAACAACTATAAGACCA |
| | | | CACCACCCATGCTGGACTCCGAC |
| | | | GGTTCTTTCTTCCTTTATAGCAAGC |
| | | | TGACAGTGGATAAATCCAGGTGGC |
| | | | AGCAGGGTAACGTATTCAGTTGCA |
| | | | GTGTCATGCACGAGGCACTCCACA |
| | | | ACCACTATACTCAGAAAAGTCTTTC |
| | | | CCTGAGTCCAGGCAAG |
| SEQ ID 2428 | QLQLQESGPGLVKPSQ TLSLTCAISGDSVSSNS AAWNWIRQSPSRGLEW LGRTYYRSKWYNDYAV SLKSRITINPDTSKNQFS LQLNSVTPEDTAVYYCA SLASGSPPPGDYWGQG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2536 | CAGCTGCAGCTGCAGGAGTCGGG TCCAGGACTGGTGAAGCCCTCGC AGACCCTCTCACTCACCTGTGCCA TCTCCGGGGACAGTGTCTCTAGCA ACAGTGCTGCTTGGAACTGGATCA GGCAGTCCCCATCGCGAGGCCTT GAGTGGCTGGGAAGGACTTACTA CAGGTCCAAGTGGTATAATGATTA TGCAGTATCTCTGAAAAGTCGAAT AACCATCAACCCGGACACATCCAA GAACCAGTTCTCCCTGCAGCTGAA CTCTGTGACTCCCGAGGACACGG CTGTATATTACTGTGCAAGTTTGG CGAGTGGTTCCCCCCTCCGGGG GACTACTGGGGCCAGGGAACCCT GGTGACCGTCTCCTCAGCAAGCA CAAAAGGTCCTTCAGTGTTCCCTC TGGCACCTTGCTCACGCAGCACCT CTGAGAGTACAGCCGCCCTGGGC TGCCTGGTAAAGGACTACTTTCCC GAACCAGTCACTGTGTCCTGGAAT AGCGGGGCCTTGACCTCTGGAGT GCACACATTTCCAGCTGTACTGCA GTCATCTGGACTCTACAGCCTGTC CAGTGTGGTCACCGTACCTTCCTC CAACTTTGGCACTCAAACATATAC ATGTAACGTGGATCATAAGCCCTC TAACACCAAAGTGGATAAACTGT GGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGTCATGCACGAGGCACTCCACA<br>ACCACTATACTCAGAAAAGTCTTTC<br>CCTGAGTCCAGGCAAG |
| SEQ ID 2429 | QVTLKESGGGVVQPGR<br>SLRLSCAASGFTFSTYG<br>MHWVRQAPGKGLEWV<br>ALISYDGSKKYYANSVK<br>GRFTISRDNSKNTLYLQ<br>MKSLRAEDTAMYYCAK<br>GPIVGATMDYWGQGAL<br>VTVSSASTKGPSVFPLA<br>PCSRSTSESTAALGCLV<br>KDYFPEPVTVSWNSGA<br>LTSGVHTFPAVLQSSGL<br>YSLSSVVTVPSSNFGTQ<br>TYTCNVDHKPSNTKVDK<br>TVERKCCVECPPCPAP<br>PVAGPSVFLFPPKPKDT<br>LMISRTPEVTCVVVDVS<br>HEDPEVQFNWYVDGVE<br>VHNAKTKPREEQFNSTF<br>RVVSVLTVVHQDWLNG<br>KEYKCKVSNKGLPAPIE<br>KTISKTKGQPREPQVYT<br>LPPSREEMTKNQVSLTC<br>LVKGFYPSDIAVEWESN<br>GQPENNYKTTPPMLDS<br>DGSFFLYSKLTVDKSRW<br>QQGNVFSCSVMHEALH<br>NHYTQKSLSLSPGK | SEQ ID 2537 | CAGGTCACCTTGAAGGAGTCTGG<br>GGGAGGCGTGGTCCAGCCTGGGA<br>GGTCCCTGAGACTCTCCTGTGCAG<br>CCTCTGGATTCACCTTCAGTACCT<br>ATGGCATGCACTGGGTCCGCCAG<br>GCTCCAGGCAAGGGGCTGGAGTG<br>GGTGGCACTTATATCATATGATGG<br>AAGTAAAAAATACTATGCAAACTCC<br>GTGAAGGGCCGATTCACCATCTCC<br>AGAGACAATTCCAAGAACACGTTG<br>TATCTGCAAATGAAAAGTCTGAGA<br>GCTGAGGACACGGCTATGTATTAC<br>TGTGCGAAAGGCCCTATAGTGGG<br>AGCGACTATGGACTACTGGGGCC<br>AGGGGAGCCCTGGTCACCGTCTCC<br>TCAGCAAGCACAAAAGGTCCTTCA<br>GTGTTCCCTCTGGCACCTTGCTCA<br>CGCAGCACCTCTGAGAGTACAGC<br>CGCCCTGGGCTGCCTGGTAAAGG<br>ACTACTTTCCCGAACCAGTCACTG<br>TGTCCTGGAATAGCGGGGCCTTG<br>ACCTCTGGAGTGCACACATTTCCA<br>GCTGTACTGCAGTCATCTGGACTC<br>TACAGCCTGTCCAGTGTGGTCACC<br>GTACCTTCCTCCAACTTTGGCACT<br>CAAACATATACATGTAACGTGGAT<br>CATAAGCCCTCTAACACCAAAGTG<br>GATAAAACTGTGGAGCGTAAGTGT<br>TGTGTCGAGTGTCCTCCTTGTCCT<br>GCTCCTCCTGTGGCAGGCCCATCT<br>GTGTTTCTCTTTCCCCCAAAGCCA<br>AAGGACACTTTGATGATATCCCGG<br>ACCCCTGAGGTGACTTGCGTCGTC<br>GTAGATGTTTCACACGAAGATCCA<br>GAGGTGCAGTTCAACTGGTACGTG<br>GATGGCGTGGAAGTGCATAATGC<br>CAAGACAAAGCCCCGCGAAGAGC<br>AGTTTAATTCCACCTTCCGCGTGG<br>TGTCTGTGCTGACCGTGGTACATC<br>AGGATTGGCTTAACGGTAAGGAGT<br>ACAAGTGCAAGGTGAGTAACAAGG<br>GCTGCCCGCCCCTATCGAGAAG<br>ACTATCAGTAAAACCAAGGGCCAG<br>CCAAGGGAGCCACAGGTGTACAC<br>ACTTCCACCATCTAGGGAGGAAAT<br>GACAAAGAACCAGGTGAGTTTGAC<br>CTGTCTCGTGAAAGGCTTTTATCC<br>CAGTGATATAGCCGTGGAATGGGA<br>AAGTAACGGGCAGCCCGAGAACA<br>ACTATAAGACCACACCACCCATGC<br>TGGACTCCGACGGTTCTTTCTTCC<br>TTTATAGCAAGCTGACAGTGGATA<br>AATCCAGGTGGCAGCAGGGTAAC<br>GTATTCAGTTGCAGTGTCATGCAC<br>GAGGCACTCCACAACCACTATACT<br>CAGAAAAGTCTTTCCCTGAGTCCA<br>GGCAAG |
| SEQ ID 2430 | EVQLVQSGAEVKKPGS<br>SVKVSCKASGGTFSSYA<br>ISWVRQAPGQGLEWMG<br>WISAYNGNTNYAQKLQ<br>GRVTMTTDTSTSTAYM<br>ELRSLRSDDTAVYYCAR<br>WYGDYGLDYWGQGTL<br>VTVSSASTKGPSVFPLA<br>PCSRSTSESTAALGCLV<br>KDYFPEPVTVSWNSGA<br>LTSGVHTFPAVLQSSGL<br>YSLSSVVTVPSSNFGTQ<br>TYTCNVDHKPSNTKVDK<br>TVERKCCVECPPCPAP | SEQ ID 2538 | GAGGTGCAGCTGGTGCAGTCTGG<br>GGCTGAGGTGAAGAAGCCTGGGT<br>CCTCGGTGAAGGTCTCCTGCAAG<br>GCTTCTGGAGGCACCTTCAGCAG<br>CTATGCTATCAGCTGGGTGCGACA<br>GGCCCCTGGACAAGGGCTTGAGT<br>GGATGGGATGGATCAGCGCTTAC<br>AATGGTAACACAAACTATGCACAG<br>AAGCTCCAGGGCAGAGTCACCAT<br>GACCACAGACACATCCACGAGCA<br>CAGCCTACATGGAGCTGAGGAGC<br>CTGAGATCTGACGACACGGCCGT<br>GTATTACTGTGCGAGATGGTACGG<br>TGACTACGGCCTTGACTACTGGGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | | CCAGGGAACCCTGGTCACCGTCT CCTCAGCAAGCACAAAAGGTCCTT CAGTGTTCCCTCTGGCACCTTGCT CACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2431 | EVQLVQSGAEVKKPGA SVKVSCKASGYTFTSYA MHWVRQAPGQRLAWM GWINAGNGNTKYSEKF EGRVTITRDTSASTAYM ELSSLRSEDTAVYYCAR VAKYYYESGGYRASNW FDPWGQGTLVTVSSAS TKGPSVFPLAPCSRSTS ESTAALGCLVKDYFPEP VTVSWNSGALTSGVHT FPAVLQSSGLYSLSSVV TVPSSNFGTQTYTCNVD HKPSNTKVDKTVERKC CVECPPCPAPPVAGPS VFLFPPKPKDTLMISRTP EVTCVVVDVSHEDPEV QFNWYVDGVEVHNAKT KPREEQFNSTFRVVSVL TVVHQDWLNGKEYKCK VSNKGLPAPIEKTISKTK GQPREPQVYTLPPSRE EMTKNQVSLTCLVKGFY PSDIAVEWESNGQPEN NYKTTPPMLDSDGSFFL YSKLTVDKSRWQQGNV FSCSVMHEALHNHYTQ KSLSLSPGK | SEQ ID 2539 | GAGGTCCAGCTGGTGCAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGCGTG GATGGGATGGATCAACGCTGGCA ATGGTAACACAAAATATTCAGAGA AGTTCGAAGGCAGAGTCACCATCA CCAGGGACACATCCGCGAGCACA GCCTACATGGAGCTGAGCAGCCT GAGATCTGAAGACACGGCTGTGTA TTACTGTGCGAGGGTCGCCAAATA TTATTACGAGAGTGGTGGTTATCG GGCCTCCAACTGGTTCGACCCCT GGGGCCAGGGCACCCTGGTCACC GTCTCCTCAGCAAGCACAAAAGGT CCTTCAGTGTTCCCTCTGGCACCT TGCTCACGCAGCACCTCTGAGAGT ACAGCCGCCCTGGGCTGCCTGGT AAAGGACTACTTTCCCGAACCAGT CACTGTGTCCTGGAATAGCGGGG CCTTGACCTCTGGAGTGCACACAT TTCCAGCTGTACTGCAGTCATCTG GACTCTACAGCCTGTCCAGTGTGG TCACCGTACCTTCCTCCAACTTTG GCACTCAAACATATACATGTAACG TGGATCATAAGCCCTCTAACACCA AAGTGGATAAAACTGTGGAGCGTA AGTGTTGTGTCGAGTGTCCTCCTT GTCCTGCTCCTCCTGTGGCAGGC CCATCTGTGTTTCTCTTTCCCCCAA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGCCAAAGGACACTTTGATGATAT
CCCGGACCCCTGAGGTGACTTGC
GTCGTCGTAGATGTTTCACACGAA
GATCCAGAGGTGCAGTTCAACTGG
TACGTGGATGGCGTGGAAGTGCA
TAATGCCAAGACAAAGCCCCGCGA
AGAGCAGTTTAATTCCACCTTCCG
CGTGGTGTCTGTGCTGACCGTGG
TACATCAGGATTGGCTTAACGGTA
AGGAGTACAAGTGCAAGGTGAGTA
ACAAGGGGCTGCCCGCCCCTATC
GAGAAGACTATCAGTAAAACCAAG
GGCCAGCCAAGGGAGCCACAGGT
GTACACACTTCCACCATCTAGGGA
GGAAATGACAAAGAACCAGGTGA
GTTTGACCTGTCTCGTGAAAGGCT
TTTATCCCAGTGATATAGCCGTGG
AATGGGAAAGTAACGGGCAGCCC
GAGAACAACTATAAGACCACACCA
CCCATGCTGGACTCCGACGGTTCT
TTCTTCCTTTATAGCAAGCTGACA
GTGGATAAATCCAGGTGGCAGCA
GGGTAACGTATTCAGTTGCAGTGT
CATGCACGAGGCACTCCACAACCA
CTATACTCAGAAAAGTCTTTCCCT
GAGTCCAGGCAAG |
| SEQ ID 2432 | QVQLQESGPGLVKPSQ
TLSLTCAISGDSVSSNS
AAWNWIRQSPSRGLEW
LGRTYYRSKWYNDYAV
SVKSRITINPDTSKNQFS
LQLNSVTPEDTAVYYCA
RAPPPTVGWYAPVFDY
WGQGTLVTVSSASTKG
PSVFPLAPCSRSTSEST
AALGCLVKDYFPEPVTV
SWNSGALTSGVHTFPA
VLQSSGLYSLSSVVTVP
SSNFGTQTYTCNVDHK
PSNTKVDKTVERKCCVE
CPPCPAPPVAGPSVFLF
PPKPKDTLMISRTPEVT
CVVVDVSHEDPEVQFN
WYVDGVEVHNAKTKPR
EEQFNSTFRVVSVLTVV
HQDWLNGKEYKCKVSN
KGLPAPIEKTISKTKGQP
REPQVYTLPPSREEMTK
NQVSLTCLVKGFYPSDI
AVEWESNGQPENNYKT
TPPMLDSDGSFFLYSKL
TVDKSRWQQGNVFSCS
VMHEALHNHYTQKSLSL
SPGK | SEQ ID 2540 | CAGGTGCAGCTGCAGGAGTCAGG
TCCAGGACTGGTGAAGCCCTCGC
AGACCCTCTCACTCACCTGTGCCA
TCTCCGGGGACAGTGTCTCTAGCA
ACAGTGCTGCTTGGAACTGGATCA
GGCAGTCCCCATCGAGAGGCCTT
GAGTGGCTGGGAAGGACATACTA
CAGGTCCAAGTGGTATAATGATTA
TGCAGTATCTGTGAAAAGTCGAAT
AACCATCAACCCAGACACATCCAA
GAACCAGTTCTCCCTGCAGCTGAA
CTCTGTGACTCCCGAGGACACGG
CTGTGTATTACTGTGCAAGAGCGC
CCCCTCCGACTGTTGGCTGGTAC
GCCCCCGTCTTTGACTACTGGGG
CCAGGGAACCCTGGTCACCGTCT
CCTCAGCAAGCACAAAAGGTCCTT
CAGTGTTCCCTCTGGCACCTTGCT
CACGCAGCACCTCTGAGAGTACA
GCCGCCCTGGGCTGCCTGGTAAA
GGACTACTTTCCCGAACCAGTCAC
TGTGTCCTGGAATAGCGGGCCTT
GACCCTCTGGAGTCCACACATTTCC
AGCTGTACTGCAGTCATCTGGACT
CTACAGCCTGTCCAGTGTGGTCAC
CGTACCTTCCTCCAACTTTGGCAC
TCAAACATATACATGTAACGTGGA
TCATAAGCCCTCTAACACCAAAGT
GGATAAAACTGTGGAGCGTAAGTG
TTGTGTCGAGTGTCCTCCTTGTCC
TGCTCCTCCTGTGGCAGGCCCATC
TGTGTTTCTCTTTCCCCCAAAGCC
AAAGGACACTTTGATGATATCCCG
GACCCCTGAGGTGACTTGCGTCG
TCGTAGATGTTTCACACGAAGATC
CAGAGGTGCAGTTCAACTGGTACG
TGGATGGCGTGGAAGTGCATAATG
CCAAGACAAAGCCCCGCGAAGAG
CAGTTTAATTCCACCTTCCGCGTG
GTGTCTGTGCTGACCGTGGTACAT
CAGGATTGGCTTAACGGTAAGGAG
TACAAGTGCAAGGTGAGTAACAAG
GGGCTGCCCGCCCCTATCGAGAA
GACTATCAGTAAAACCAAGGGCCA
GCCAAGGGAGCCACAGGTGTACA
CACTTCCACCATCTAGGGAGGAAA
TGACAAAGAACCAGGTGAGTTTGA
CCTGTCTCGTGAAAGGCTTTTATC
CCAGTGATATAGCCGTGGAATGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GAAAGTAACGGGCAGCCCGAGAA |
| | | | CAACTATAAGACCACACCACCCAT |
| | | | GCTGGACTCCGACGGTTCTTTCTT |
| | | | CCTTTATAGCAAGCTGACAGTGGA |
| | | | TAAATCCAGGTGGCAGCAGGGTAA |
| | | | CGTATTCAGTTGCAGTGTCATGCA |
| | | | CGAGGCACTCCACAACCACTATAC |
| | | | TCAGAAAAGTCTTTCCCTGAGTCC |
| | | | AGGCAAG |
| SEQ ID 2433 | QLQLQESGGGLVQPGG SLRLSCSASGISFRDYW MHWIRQTPGKGLVWVS RINPDGSSTSYADSVKG RFTISRDNSKNTLYLQM NSLRAEDTAVYYCAKVT GRRVGAHDYWGQGTL VTVSSASTKGPSVFPLA PCSRSTSESTAALGCLV KDYFPEPVTVSWNSGA LTSGVHTFPAVLQSSGL YSLSSVVTVPSSNFGTQ TYTCNVDHKPSNTKVDK TVERKCCVECPPCPAP PVAGPSVFLFPPKPKDT LMISRTPEVTCVVVDVS HEDPEVQFNWYVDGVE VHNAKTKPREEQFNSTF RVVSVLTVVHQDWLNG KEYKCKVSNKGLPAPIE KTISKTKGQPREPQVYT LPPSREEMTKNQVSLTC LVKGFYPSDIAVEWESN GQPENNYKTTPPMLDS DGSFFLYSKLTVDKSRW QQGNVFSCSVMHEALH NHYTQKSLSLSPGK | SEQ ID 2541 | CAGCTGCAGCTGCAGGAGTCCGG GGGAGGCTTAGTTCAGCCGGGGG GGTCCCTGAGACTCTCCTGCTCAG CCTCTGGAATCAGCTTCAGAGATT ACTGGATGCACTGGATCCGCCAAA CTCCAGGGAAGGGGCTGGTGTGG GTCTCACGTATTAATCCTGATGGG AGTAGCACAAGCTACGCGGACTC CGTGAAGGGCCGATTCACCATCTC CAGAGACAATTCCAAGAACACGCT GTATCTGCAAATGAACAGCCTGAG AGCTGAGGACACGGCTGTGTATTA CTGTGCGAAAGTTACGGGACGGA GAGTGGGAGCCCATGACTACTGG GGCCAGGGAACCCTGGTCACCGT CTCCTCAGCAAGCACAAAAGGTCC TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2434 | QVQLVQSGAEVKKPGA SVKVSCKASGYTFTGYY MHWVRQAPGQGLEWM GWINPNSGGTNYAQKF QGRVTMTRDTSISTAYM ELSRLRSDDTAVYYCAF AQPGAETLNFDLWGRG TLVTVSSASTKGPSVFP | SEQ ID 2542 | CAGGTGCAGCTGGTGCAGTCTGG GGCTGAGGTGAAGAAGCCTGGGG CCTCAGTGAAGGTCTCCTGCAAGG CTTCTGGATACACCTTCACCGGCT ACTATATGCACTGGGTGCGACAGG CCCCTGGACAAGGGCTTGAGTGG ATGGGATGGATCAACCCTAACAGT GGTGGCACAAACTATGCACAGAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | LAPCSRSTSESTAALGC<br>LVKDYFPEPVTVSWNS<br>GALTSGVHTFPAVLQSS<br>GLYSLSSVVTVPSSNFG<br>TQTYTCNVDHKPSNTKV<br>DKTVERKCCVECPPCP<br>APPVAGPSVFLFPPKPK<br>DTLMISRTPEVTCVVVD<br>VSHEDPEVQFNWYVDG<br>VEVHNAKTKPREEQFN<br>STFRVVSVLTVVHQDWL<br>NGKEYKCKVSNKGLPA<br>PIEKTISKTKGQPREPQV<br>YTLPPSREEMTKNQVSL<br>TCLVKGFYPSDIAVEWE<br>SNGQPENNYKTTPPML<br>DSDGSFFLYSKLTVDKS<br>RWQQGNVFSCSVMHE<br>ALHNHYTQKSLSLSPGK | | TTTCAGGGCAGGGTCACCATGACC<br>AGGGACACGTCCATCAGCACAGC<br>CTACATGGAGCTGAGCAGGCTGA<br>GATCTGACGACACGGCCGTGTATT<br>ACTGTGCCTTTGCCCAGCCGGGC<br>GCTGAGACGTTGAACTTCGATCTC<br>TGGGGCCGTGGCACCCTGGTCAC<br>CGTCTCCTCAGCAAGCACAAAAGG<br>TCCTTCAGTGTTCCCTCTGGCACC<br>TTGCTCACGCAGCACCTCTGAGAG<br>TACAGCCGCCCTGGGCTGCCTGG<br>TAAAGGACTACTTTCCCGAACCAG<br>TCACTGTGTCCTGGAATAGCGGG<br>GCCTTGACCTCTGGAGTGCACACA<br>TTTCCAGCTGTACTGCAGTCATCT<br>GGACTCTACAGCCTGTCCAGTGTG<br>GTCACCGTACCTTCCTCCAACTTT<br>GGCACTCAAACATATACATGTAAC<br>GTGGATCATAAGCCCTCTAACACC<br>AAAGTGGATAAAACTGTGGAGCGT<br>AAGTGTTGTGTCGAGTGTCCTCCT<br>TGTCCTGCTCCTCCTGTGGCAGGC<br>CCATCTGTGTTTCTCTTTCCCCCAA<br>AGCCAAAGGACACTTTGATGATAT<br>CCCGGACCCCTGAGGTGACTTGC<br>GTCGTCGTAGATGTTTCACACGAA<br>GATCCAGAGGTGCAGTTCAACTGG<br>TACGTGGATGGCGTGGAAGTGCA<br>TAATGCCAAGACAAAGCCCCGCGA<br>AGAGCAGTTTAATTCCACCTTCCG<br>CGTGGTGTCTGTGCTGACCGTGG<br>TACATCAGGATTGGCTTAACGGTA<br>AGGAGTACAAGTGCAAGGTGAGTA<br>ACAAGGGGCTGCCCGCCCCTATC<br>GAGAAGACTATCAGTAAAACCAAG<br>GGCCAGCCAAGGGAGCCACAGGT<br>GTACACACTTCCACCATCTAGGGA<br>GGAAATGACAAAGAACCAGGTGA<br>GTTTGACCTGTCTCGTGAAAGGCT<br>TTTATCCCAGTGATATAGCCGTGG<br>AATGGGAAAGTAACGGGCAGCCC<br>GAGAACAACTATAAGACCACACCA<br>CCCATGCTGGACTCCGACGGTTCT<br>TTCTTCCTTTATAGCAAGCTGACA<br>GTGGATAAATCCAGGTGGCAGCA<br>GGGTAACGTATTCAGTTGCAGTGT<br>CATGCACGAGGCACTCCACAACCA<br>CTATACTCAGAAAAGTCTTTCCCT<br>GAGTCCAGGCAAG |
| SEQ ID 2435 | QVQLQQSGPGLVKPSQ<br>TLSLTCAISGDSVSSKSA<br>AWNWIRQSPSRGLEWL<br>GRTYYRSKWNNDYALS<br>VKSRITINPDTSKNQFSL<br>QLKSVTPEDTALYYCVR<br>QVAGGMDVWGQGTTV<br>TVSSASTKGPSVFPLAP<br>CSRSTSESTAALGCLVK<br>DYFPEPVTVSWNSGAL<br>TSGVHTFPAVLQSSGLY<br>SLSSVVTVPSSNFGTQT<br>YTCNVDHKPSNTKVDKT<br>VERKCCVECPPCPAPP<br>VAGPSVFLFPPKPKDTL<br>MISRTPEVTCVVVDVSH<br>EDPEVQFNWYVDGVEV<br>HNAKTKPREEQFNSTFR<br>VVSVLTVVHQDWLNGK<br>EYKCKVSNKGLPAPIEK<br>TISKTKGQPREPQVYTL<br>PPSREEMTKNQVSLTCL<br>VKGFYPSDIAVEWESNG<br>QPENNYKTTPPMLDSD | SEQ ID 2543 | CAGGTACAGCTGCAGCAGTCAGG<br>TCCAGGACTGGTGAAGCCCTCGC<br>AGACCCTCTCACTCACCTGTGCCA<br>TCTCCGGGGACAGTGTCTCTAGCA<br>AAAGTGCTGCTTGGAACTGGATCA<br>GGCAGTCCCCATCGAGAGGCCTT<br>GAGTGGCTGGGAAGGACATACTA<br>CAGGTCCAAATGGAATAATGATTA<br>TGCATTATCTGTGAAAAGTCGAAT<br>AACCATCAACCCAGACACATCCAA<br>GAACCAGTTCTCCCTGCAGCTGAA<br>GTCTGTGACTCCCGAGGACACGG<br>CTCTGTATTACTGTGTAAGACAAG<br>TCGCGGGCGGTATGGACGTCTGG<br>GGCCAAGGGACCACGGTCACCGT<br>CTCCTCAGCAAGCACAAAGGTCC<br>TTCAGTGTTCCCTCTGGCACCTTG<br>CTCACGCAGCACCTCTGAGAGTAC<br>AGCCGCCCTGGGCTGCCTGGTAA<br>AGGACTACTTTCCCGAACCAGTCA<br>CTGTGTCCTGGAATAGCGGGGCC<br>TTGACCTCTGGAGTGCACACATTT<br>CCAGCTGTACTGCAGTCATCTGGA<br>CTCTACAGCCTGTCCAGTGTGGTC |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | GSFFLYSKLTVDKSRW QQGNVFSCSVMHEALH NHYTQKSLSLSPGK | | ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2436 | QVQLVQSGGGLVQPGR SLRLSCTASGFTFGDYA MSWFRQAPGKGLEWV SAISGSGGSTYYADSVK GRFTISRDNSKNTLYLQ MNSLRAEDTAVYYCAK GSVYSGSYYMLIDYWG QGTLVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2544 | CAGGTGCAGCTGGTGCAATCTGG GGGAGGCTTGGTACAGCCAGGGC GGTCCCTGAGACTCTCCTGTACAG CTTCTGGATTCACCTTTGGTGATTA TGCTATGAGCTGGTTCCGCCAGG CTCCAGGGAAGGGGCTGGAGTGG GTCTCAGCTATTAGTGGTAGTGGT GGTAGCACATACTATGCAGACTCC GTGAAGGGCCGATTCACCATCTCC AGAGACAATTCCAAGAACACGCTG TATCTGCAAATGAACAGCCTGAGA GCTGAGGACACGGCTGTGTATTAC TGTGCGAAAGGATCGGTATATAGT GGGAGCTACTATATGCTCATTGAC TACTGGGGCCAGGGCACCCTGGT CACCGTCTCCTCAGCAAGCACAAA AGGTCCTTCAGTGTTCCCTCTGGC ACCTTGCTCACGCAGCACCTCTGA GAGTACAGCCGCCCTGGGCTGCC TGGTAAAGGACTACTTTCCCGAAC CAGTCACTGTGTCCTGGAATAGCG GGGCCTTGACCTCTGGAGTGCAC ACATTTCCAGCTGTACTGCAGTCA TCTGGACTCTACAGCCTGTCCAGT GTGGTCACCGTACCTTCCTCCAAC TTTGGCACTCAAACATATACATGTA ACGTGGATCATAAGCCCTCTAACA CCAAAGTGGATAAAACTGTGGAGC GTAAGTGTTGTGTCGAGTGTCCTC CTTGTCCTGCTCCTCCTGTGGCAG GCCCATCTGTGTTTCTCTTTCCCC CAAAGCCAAAGGACACTTTGATGA TATCCCGGACCCCTGAGGTGACTT GCGTCGTCGTAGATGTTTCACACG AAGATCCAGAGGTGCAGTTCAACT GGTACGTGGATGGCGTGGAAGTG CATAATGCCAAGACAAAGCCCCGC GAAGAGCAGTTTAATTCCACCTTC CGCGTGGTGTCTGTGCTGACCGT GGTACATCAGGATTGGCTTAACGG TAAGGAGTACAAGTGCAAGGTGAG TAACAAGGGGCTGCCCGCCCCTA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | TCGAGAAGACTATCAGTAAAACCA AGGGCCAGCCAAGGGAGCCACAG GTGTACACACTTCCACCATCTAGG GAGGAAATGACAAAGAACCAGGT GAGTTTGACCTGTCTCGTGAAAGG CTTTTATCCCAGTGATATAGCCGT GGAATGGGAAAGTAACGGGCAGC CCGAGAACAACTATAAGACCACAC CACCCATGCTGGACTCCGACGGTT CTTTCTTCCTTTATAGCAAGCTGAC AGTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2437 | QVQLQQSGPGLVRPSQ TLSLTCVISGDSVSSGS AAWNWIRQSPSRGLEW LGRTYYRAKWYNEYAG SVKSRITISPDTSKNQFS LQLNSVTPEDTAVYFCT RQDKDNTRYSGLGVWG QGTTVTVSSASTKGPSV FPLAPCSRSTSESTAAL GCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2545 | CAGGTACAGCTGCAGCAGTCAGG TCCAGGACTGGTGAGGCCCTCGC AGACCCTCTCACTCACCTGTGTCA TCTCCGGGGACAGTGTCTCTAGC GGCAGTGCTGCTTGGAACTGGAT CAGGCAGTCCCCATCGAGAGGCC TTGAGTGGCTGGGAAGGACATATT ATAGGGCCAAGTGGTATAATGAAT ATGCAGGGTCTGTGAAAAGCGAA TAACCATCAGTCCGGACACATCCA AGAACCAGTTCTCCCTGCAACTGA ACTCTGTGACTCCGAGGACACG GCTGTGTATTTCTGTACAAGACAA GACAAAGACAACACGAGATATTCC GGTTTGGGCGTCTGGGCCAAGG GACCACGGTGACCGTCTCCTCAG CAAGCACAAAGGTCCTTCAGTGT TCCCTCTGGCACCTTGCTCACGCA GCACCTCTGAGAGTACAGCCGCC CTGGGCTGCCTGGTAAAGGACTA CTTTCCCGAACCAGTCACTGTGTC CTGGAATAGCGGGGCCTTGACCT CTGGAGTGCACACATTTCCAGCTG TACTGCAGTCATCTGGACTCTACA GCCTGTCCAGTGTGGTCACCGTAC CTTCCTCCAACTTTGGCACTCAAA CATATACATGTAACGTGGATCATA AGCCCTCTAACACCAAAGTGGATA AAACTGTGGAGCGTAAGTGTTGTG TCGAGTGTCCTCCTTGTCCTGCTC CTCCTGTGGCAGGCCCATCTGTGT TTCTCTTTCCCCCAAAGCCAAAGG ACACTTTGATGATATCCCGGACCC CTGAGGTGACTTGCGTCGTCGTAG ATGTTTCACACGAAGATCCAGAGG TGCAGTTCAACTGGTACGTGGATG GCGTGGAAGTGCATAATGCCAAGA CAAAGCCCCGCGAAGAGCAGTTTA ATTCCACCTTCCGCGTGGTGTCTG TGCTGACCGTGGTACATCAGGATT GGCTTAACGGTAAGGAGTACAAGT GCAAGGTGAGTAACAAGGGGCTG CCCGCCCCTATCGAGAAGACTATC AGTAAAACCAAGGGCCAGCCAAG GGAGCCACAGGTGTACACACTTCC ACCATCTAGGGAGGAAATGACAAA GAACCAGGTGAGTTTGACCTGTCT CGTGAAAGGCTTTTATCCCAGTGA TATAGCCGTGGAATGGGAAAGTAA CGGGCAGCCCGAGAACAACTATA AGACCACACCACCCATGCTGGACT CCGACGGTTCTTTCTTCCTTTATAG CAAGCTGACAGTGGATAAATCCAG GTGGCAGCAGGGTAACGTATTCA GTTGCAGTGTCATGCACGAGGCA CTCCACAACCACTATACTCAGAAA AGTCTTTCCCTGAGTCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2438 | EVQLVETGGGLVQPGGSLRLSCAASEFTLRNYGVSWRQAPGKGLEWSGMSGSGYSTYYADSVKGRFTISRDSSKNTLFLQMDSLRAEDTAIYYCARGPRMWSSGIDAFDIWGHGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK | SEQ ID 2546 | GAGGTGCAGCTGGTGGAGACCGGGGGAGGCTTAGTTCAGCCTGGGGGGTCCCTGAGACTCTCCTGTGCAGCCTCTGAATTCACCCTTAGGAACTATGGCGTGAGCTGGGTCCGCCAGGCTCCAGGGAAGGGGCTGGAGTGGGTCTCAGGTATGAGTGGTAGTGGTTATAGTACATACTACGCAGACTCCGTGAAGGGCCGGTTCACCATCTCCAGAGACAGTTCCAAGAACACGCTGTTTCTGCAAATGGACAGCCTGAGAGCCGAGGACACGGCCATATATTACTGTGCGAGAGGGCCCCGAATGTGGAGCAGTGGCATTGATGCTTTTGATATCTGGGGCCACGGGACAATGGTGACCGTCTCTTCAGCAAGCACAAAAGGTCCTTCAGTGTTCCCTCTGGCACCTTGCTCACGCAGCACCTCTGAGAGTACAGCCGCCCTGGGCTGCCTGGTAAAGGACTACTTTCCCGAACCAGTCACTGTCCTGGAATAGCGGGGCCTTGACCTCTGGAGTGCACACATTTCCAGCTGTACTGCAGTCATCTGGACTCTACAGCCTGTCCAGTGTGGTCACCGTACCTTCCTCCAACTTTGGCACTCAAACATATACATGTAACGTGGATCATAAGCCCTCTAACACCAAAGTGGATAAAACTGTGGAGCGTAAGTGTTGTGTCGAGTGTCCTCCTTGTCCTGCTCCTCCTGTGGCAGGCCCATCTGTGTTTCTCTTTCCCCCAAAGCCAAAGGACACTTTGATGATATCCCGGACCCCTGAGGTGACTTGCGTCGTCGTAGATGTTTCACACGAAGATCCAGAGGTGCAGTTCAACTGGTACGTGGATGGCGTGGAAGTGCATAATGCCAAGACAAAGCCCCGCGAAGAGCAGTTTAATTCCACCTTCCGCGTGGTGTCTGTGCTGACCGTGGTACATCAGGATTGGCTTAACGGTAAGGAGTACAAGTGCAAGGTGAGTAACAAGGGGCTGCCCGCCCCTATCGAGAAGACTATCAGTAAAACCAAGGGCCAGCCAAGGGAGCCACAGGTGTACACACTTCCACCATCTAGGGAGGAAATGACAAAGAACCAGGTGAGTTTGACCTGTCTCGTGAAAGGCTTTTATCCCAGTGATATAGCCGTGGAATGGGAAAGTAACGGGCAGCCCGAGAACAACTATAAGACCACACCACCCATGCTGGACTCCGACGGTTCTTTCTTCCTTTATAGCAAGCTGACAGTGGATAAATCCAGGTGGCAGCAGGGTAACGTATTCAGTTGCAGTGTCATGCACGAGGCACTCCACAACCACTATACTCAGAAAAGTCTTTCCCTGAGTCCAGGCAAG |
| SEQ ID 2439 | QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSSASTKGPSVFPLAPCSRSTSESTAALGCLVKDYFPEPVTVSWNSGALTSGVHTFPAVLQSSGLYSLSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVV | SEQ ID 2547 | CAGGTGCAGCTACAGCAGTGGGGCGCAGGACTGTTGAAGCCTTCGGAGACCCTGTCCCTCACCTGCGCTGTCTATGGTGGGTCCGTCAGTGGTTACTACTGGAGCTGGATCCGCCAGCCCCCAGGGAAGGGGCTGGAGTGGATGGGGGAAATCCATCATAGTGGAAGCACCAACTACAACCCGTCCCTCAAGAGTCGAGTCACCATATCACTAGACACGCCCAAGAACCAGTTCTCCCTGAAGCTAAGCTCTGTGACCGCCGCGGACACGGCTGTATATTACTGTGCGAGACGGGATTGGGCAGGAAAAGGGTCTGGGGCCAGGGAACCCTGGTCACCGTCTCCTCAGCAAGCACAAAAGGTCCTTCAGTGTTCCCTCTGGCACCTTGCTCACGCAGCACCTCTGAGAGTACAGCCGCCCTGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | SVLTVVHQDWLNGKEY KCKVSNKGLPAPIEKTIS KTKGQPREPQVYTLPPS REEMTKNQVSLTCLVK GFYPSDIAVEWESNGQ PENNYKTTPPMLDSDG SFFLYSKLTVDKSRWQ QGNVFSCSVMHEALHN HYTQKSLSLSPGK | | GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2440 | QVQLQQSGPGLLKPSQ TLSLTCAISGDSVSSNTA TWNWIRQSPSRGLEWL GRTYYRSKWYKDNALS VKSRITINPDTSKNQFSL QLNSVTPEDTAVYYCAG GRAGIAAFDIWGQGTTV TVSSASTKGPSVFPLAP CSRSTSESTAALGCLVK DYFPEPVTVSWNSGAL TSGVHTFPAVLQSSGLY SLSSVVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2548 | CAGGTACAGCTGCAGCAGTCAGG TCCAGGACTATTAAAGCCCTCGCA GACCCTCTCACTCACCTGTGCCAT CTCCGGGGACAGTGTCTCTAGCAA CACTGCTACTTGGAACTGGATCAG GCAGTCCCCATCGAGAGGCCTTG AGTGGCTGGGAAGGACATACTACA GGTCCAAGTGGTATAAGGATAATG CACTGTCTGTGAAAAGTCGAATAA CCATCAACCCAGACACATCCAAGA ACCAGTTCTCCCTGCAGCTGAACT CTGTGACTCCGAGGACACGGCT GTGTATTACTGTGCAGGAGGTCGG GCTGGTATTGCCGCTTTTGATATC TGGGGCCAAGGGACCACGGTCAC CGTCTCCTCAGCAAGCACAAAAGG CCTTGACCTCTGGAGTGCACACA TTTCCAGCTGTACTGCAGTCATCT GGACTCTACAGCCTGTCCAGTGTG GTCACCGTACCTTCCTCCAACTTT GGCACTCAAACATATACATGTAAC GTGGATCATAAGCCCTCTAACACC AAAGTGGATAAAACTGTGGAGCGT AAGTGTTGTGTCGAGTGTCCTCCT TGTCCTGCTCCTCCTGTGGCAGGC CCATCTGTGTTTCTCTTTCCCCCAA AGCCAAAGGACACTTTGATGATAT CCCGGACCCCTGAGGTGACTTGC GTCGTCGTAGATGTTTCACACGAA GATCCAGAGGTGCAGTTCAACTGG TACGTGGATGGCGTGGAAGTGCA TAATGCCAAGACAAAGCCCCGCGA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AGAGCAGTTTAATTCCACCTTCCG CGTGGTGTCTGTGCTGACCGTGG TACATCAGGATTGGCTTAACGGTA AGGAGTACAAGTGCAAGGTGAGTA ACAAGGGGCTGCCCGCCCCTATC GAGAAGACTATCAGTAAAACCAAG GGCCAGCCAAGGGAGCCACAGGT GTACACACTTCCACCATCTAGGGA GGAAATGACAAAGAACCAGGTGA GTTTGACCTGTCTCGTGAAAGGCT TTTATCCCAGTGATATAGCCGTGG AATGGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2441 | QVQLVQSGGGLIQPGG SLRLSCAASGFTVSSNY MSWVRQAPGKGLEWV SLIYSDGRTNYADSVKG RFTISRDNSKNTLYLQM NSLRAEDTAVYYCAKGA LQGEWRRFDYWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2549 | CAGGTGCAGCTGGTGCAATCTGG AGGAGGCTTGATCCAGCCTGGGG GGTCCCTGAGACTCTCCTGTGCAG CCTCTGGGTTCACCGTCAGTAGCA ACTACATGAGCTGGGTCCGCCAG GCTCCAGGGAAGGGGCTGGAATG GGTCTCACTTATTTATAGTGATGGT CGCACAAACTATGCAGACTCCGTG AAGGGCCGATTCACCATCTCCAGA GACAATTCCAAGAACACGCTGTAT CTGCAAATGAACAGCCTGAGAGCC GAGGACACGGCCGTATATTACTGT GCGAAGGGGGCCCTACAGGGCGA ATGGCGGAGATTTGACTACTGGG GCCAGGGCACCCTGGTCACCGTC TCCTCAGCAAGCACAAAAGGTCCT TCAGTGTTCCCTCTGGCACCTTGC TCACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CGAGGCACTCCACAACCACTATAC TCAGAAAAGTCTTTCCCTGAGTCC AGGCAAG |
| SEQ ID 2442 | QVQLQQSGPGLVKPSQ TLSLTCAISGDSVSSNS AAWNWIRQSPSRGLEW LGRTYYRSKWYNDYAV SVKSRITINPDTSKNQFS LQLNSVTPEDTAVYYCT RTNQGYGGNSGVFDY WGQGTLVTVSSASTKG PSVFPLAPCSRSTSEST AALGCLVKDYFPEPVTV SWNSGALTSGVHTFPA VLQSSGLYSLSSVVTVP SSNFGTQTYTCNVDHK PSNTKVDKTVERKCCVE CPPCPAPPVAGPSVFLF PPKPKDTLMISRTPEVT CVVVDVSHEDPEVQFN WYVDGVEVHNAKTKPR EEQFNSTFRVVSVLTVV HQDWLNGKEYKCKVSN KGLPAPIEKTISKTKGQP REPQVYTLPPSREEMTK NQVSLTCLVKGFYPSDI AVEWESNGQPENNYKT TPPMLDSDGSFFLYSKL TVDKSRWQQGNVFSCS VMHEALHNHYTQKSLSL SPGK | SEQ ID 2550 | CAGGTGCAGCTACAGCAGTCAGG TCCAGGACTGGTGAAGCCCTCGC AGACCCTCTCACTCACCTGTGCCA TCTCCGGGGACAGTGTCTCTAGCA ACAGTGCTGCTTGGAACTGGATCA GGCAGTCCCCATCGAGAGGCCTT GAGTGGCTGGGAAGGACATATTAC AGGTCCAAGTGGTATAATGATTAT GCAGTATCTGTGAAAAGTCGAATA ACCATCAACCCAGACACATCCAAG AACCAGTTCTCCCTGCAGCTGAAC TCTGTGACTCCCGAGGACACGGC TGTGTATTACTGTACAAGAACCAA CCAGGGATACGGTGGTAACTCCG GGGTATTTGACTACTGGGGCCAG GGAACCCTGGTCACCGTCTCCTCA GCAAGCACAAAAGGTCCTTCAGTG TTCCCTCTGGCACCTTGCTCACGC AGCACCTCTGAGAGTACAGCCGC CCTGGGCTGCCTGGTAAAGGACT ACTTTCCCGAACCAGTCACTGTGT CCTGGAATAGCGGGGCCTTGACC TCTGGAGTGCACACATTTCCAGCT GTACTGCAGTCATCTGGACTCTAC AGCCTGTCCAGTGTGGTCACCGTA CCTTCCTCCAACTTTGGCACTCAA ACATATACATGTAACGTGGATCAT AAGCCCTCTAACACCAAAGTGGAT AAAACTGTGGAGCGTAAGTGTTGT GTCGAGTGTCCTCCTTGTCCTGCT CCTCCTGTGGCAGGCCCATCTGT GTTTCTCTTTCCCCCAAAGCCAAA GGACACTTTGATGATATCCCGGAC CCCTGAGGTGACTTGCGTCGTCGT AGATGTTTCACACGAAGATCCAGA GGTGCAGTTCAACTGGTACGTGGA TGGCGTGGAAGTGCATAATGCCAA GACAAAGCCCCGCGAAGAGCAGT TTAATTCCACCTTCCGCGTGGTGT CTGTGCTGACCGTGGTACATCAGG ATTGGCTTAACGGTAAGGAGTACA AGTGCAAGGTGAGTAACAAGGGG CTGCCCGCCCCTATCGAGAAGACT ATCAGTAAAACCAAGGGCCAGCCA AGGGAGCCACAGGTGTACACACTT CCACCATCTAGGGAGGAAATGACA AAGAACCAGGTGAGTTTGACCTGT CTCGTGAAAGGCTTTTATCCCAGT GATATAGCCGTGGAATGGGAAAGT AACGGGCAGCCCGAGAACAACTA TAAGACCACACCACCCATGCTGGA CTCCGACGGTTCTTTCTTCCTTTAT AGCAAGCTGACAGTGGATAAATCC AGGTGGCAGCAGGGTAACGTATT CAGTTGCAGTGTCATGCACGAGG CACTCCACAACCACTATACTCAGA AAAGTCTTTCCCTGAGTCCAGGCA AG |
| SEQ ID 2443 | QVQLQQSGPGLVKPSQ TLSLTCAISGDSVSGNS AAWNWIRQSPSRGLEW LGRTYYRSKWYNDYAV SVKSRITINPDTSKNQFS LQLNSVTPEDTAVYYCA RIVGGAVDCWGQGTLV TVSSASTKGPSVFPLAP CSRSTSESTAALGCLVK DYFPEPVTVSWNSGAL TSGVHTFPAVLQSSGLY SLSSWVTVPSSNFGTQT YTCNVDHKPSNTKVDKT | SEQ ID 2551 | CAGGTGCAGCTACAGCAGTCAGG TCCAGGACTGGTGAAGCCCTCGC AGACCCTCTCACTCACCTGTGCCA TCTCCGGGGACAGTGTCTCTGGC AACAGTGCTGCTTGGAACTGGATC AGGCAGTCCCCATCGAGAGGCCT TGAGTGGCTGGGAAGGACATACTA CAGGTCCAAGTGGTATAATGATTA TGCAGTATCTGTGAAAAGTCGAAT AACCATCAACCCAGACACATCCAA GAACCAGTTCTCCCTGCAGTTGAA TTCTGTGACTCCCGAGGACACGG CTGTGTATTACTGTGCGAGGATAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | | TGGGAGGTGCCGTTGACTGCTGG GGCCAGGGAACCCTGGTGACCGT CTCCTCAGCAAGCACAAAAGGTCC TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2444 | EVQLVQSGAEVKKPGA SVKVSCKASGYTFTSYA MHWVRQAPGQRLEWM GWINAGNGNTKYSQKF QGRVTITRDTSASTAYM ELSSLRSEDTAVYYCAR VRVGATTVYDSWFDPW GQGTLVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2552 | GAGGTGCAGCTGGTGCAGTCTGG GGCTGAGGTGAAGAAGCCTGGGG CCTCAGTGAAGGTTTCCTGCAAGG CTTCTGGATACACCTTCACTAGCT ATGCTATGCATTGGGTGCGCCAG GCCCCCGGACAAAGGCTTGAGTG GATGGGATGGATCAACGCTGGCA ATGGTAACACAAAATATTCACAGA AGTTCCAGGGCAGAGTCACCATTA CCAGGGACACATCCGCGAGCACA GCCTACATGGAGCTGAGCAGCCT GAGATCTGAAGACACGGCTGTGTA TTACTGTGCGAGAGTTAGAGTGGG AGCTACTACTGTTTACGACAGCTG GTTCGACCCCTGGGGCCAGGGAA CCCTGGTGACCGTCTCCTCAGCAA GCACAAAAGGTCCTTCAGTGTTCC CTCTGGCACCTTGCTCACGCAGCA CCTCTGAGAGTACAGCCGCCCTG GGCTGCCTGGTAAAGGACTACTTT CCCGAACCAGTCACTGTGTCCTGG AATAGCGGGGCCTTGACCTCTGG AGTGCACACATTTCCAGCTGTACT GCAGTCATCTGGACTCTACAGCCT GTCCAGTGTGGTCACCGTACCTTC CTCCAACTTTGGCACTCAAACATA TACATGTAACGTGGATCATAAGCC CTCTAACACCAAAGTGGATAAAAC TGTGGAGCGTAAGTGTTGTGTCGA GTGTCCTCCTTGTCCTGCTCCTCC TGTGGCAGGCCCATCTGTGTTTCT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | CTTTCCCCCAAAGCCAAAGGACAC
TTTGATGATATCCCGGACCCCTGA
GGTGACTTGCGTCGTCGTAGATGT
TTCACACGAAGATCCAGAGGTGCA
GTTCAACTGGTACGTGGATGGCGT
GGAAGTGCATAATGCCAAGACAAA
GCCCCGCGAAGAGCAGTTTAATTC
CACCTTCCGCGTGGTGTCTGTGCT
GACCGTGGTACATCAGGATTGGCT
TAACGGTAAGGAGTACAAGTGCAA
GGTGAGTAACAAGGGGCTGCCCG
CCCCTATCGAGAAGACTATCAGTA
AAACCAAGGGCCAGCCAAGGGAG
CCACAGGTGTACACACTTCCACCA
TCTAGGGAGGAAATGACAAAGAAC
CAGGTGAGTTTGACCTGTCTCGTG
AAAGGCTTTTATCCCAGTGATATA
GCCGTGGAATGGGAAAGTAACGG
GCAGCCCGAGAACAACTATAAGAC
CACACCACCCATGCTGGACTCCGA
CGGTTCTTTCTTCCTTTATAGCAAG
CTGACAGTGGATAAATCCAGGTGG
CAGCAGGGTAACGTATTCAGTTGC
AGTGTCATGCACGAGGCACTCCAC
AACCACTATACTCAGAAAAGTCTTT
CCCTGAGTCCAGGCAAG |
| SEQ ID 2445 | QVQLVQSGGGLVQPGG
SLRLSCAASGFTFSSYA
MSWVRQAPGKGLEWV
SAISGSGGSTYYADSVK
GRFTISRDNSKNTLYLQ
MNSLRAEDTAVYYCAK
DGGSSPYYDSSGLLPW
YFDLWGRGTLVTVSSA
STKGPSVFPLAPCSRST
SESTAALGCLVKDYFPE
PVTVSWNSGALTSGVH
TFPAVLQSSGLYSLSSV
VTVPSSNFGTQTYTCNV
DHKPSNTKVDKTVERK
CCVECPPCPAPPVAGP
SVFLFPPKPKDTLMISRT
PEVTCVVVDVSHEDPEV
QFNWYVDGVEVHNAKT
KPREEQFNSTFRVVSVL
TVVHQDWLNGKEYKCK
VSNKGLPAPIEKTISKTK
GQPREPQVYTLPPSRE
EMTKNQVSLTCLVKGFY
PSDIAVEWESNGQPEN
NYKTTPPMLDSDGSFFL
YSKLTVDKSRWQQGNV
FSCSVMHEALHNHYTQ
KSLSLSPGK | SEQ ID 2553 | CAGGTGCAGCTGGTGCAGTCTGG
GGGAGGCTTGGTACAGCCTGGGG
GGTCCCTGAGACTCTCCTGTGCAG
CCTCTGGATTCACCTTTAGCAGCT
ATGCCATGAGCTGGGTCCGCCAG
GCTCCAGGGAAGGGGCTGGAGTG
GGTCTCAGCTATTAGTGGTAGTGG
TGGTAGCACATACTACGCAGACTC
CGTGAAGGGCCGGTTCACCATCT
CCAGAGACAATTCCAAGAACACGC
TGTATCTGCAAATGAACAGCCTGA
GAGCCGAGGACACGGCCGTATAT
TACTGTGCGAAAGATGGGGGGTC
CAGCCCATACTATGATAGTAGTGG
TTTACTACCCTGGTACTTCGATCTC
TGGGGCCGTGGCACCCTGGTCAC
CGTCTCCTCAGCAAGCACAAAAGG
TCCTTCAGTGTTCCCTCTGGCACC
TTGCTCACGCAGCACCTCTGAGAG
TACAGCCGCCCTGGGCTGCCTGG
TAAAGGACTACTTTCCCGAACCAG
TCACTGTGTCCTGGAATAGCGGG
GCCTTGACCTCTGGAGTGCACACA
TTTCCAGCTGTACTGCAGTCATCT
GGACTCTACAGCCTGTCCAGTGTG
GTCACCGTACCTTCCTCCAACTTT
GGCACTCAAACATATACATGTAAC
GTGGATCATAAGCCCTCTAACACC
AAAGTGGATAAAACTGTGGAGCGT
AAGTGTTGTGTCGAGTGTCCTCCT
TGTCCTGCTCCTCCTGTGGCAGGC
CCATCTGTGTTTCTCTTTCCCCCAA
AGCCAAAGGACACTTTGATGATAT
CCCGGACCCCTGAGGTGACTTGC
GTCGTCGTAGATGTTTCACACGAA
GATCCAGAGGTGCAGTTCAACTGG
TACGTGGATGGCGTGGAAGTGCA
TAATGCCAAGACAAAGCCCCGCGA
AGAGCAGTTTAATTCCACCTTCCG
CGTGGTGTCTGTGCTGACCGTGG
TACATCAGGATTGGCTTAACGGTA
AGGAGTACAAGTGCAAGGTGAGTA
ACAAGGGGCTGCCCGCCCCTATC
GAGAAGACTATCAGTAAAACCAAG
GGCCAGCCAAGGGAGCCACAGGT
GTACACACTTCCACCATCTAGGGA
GGAAATGACAAAGAACCAGGTGA
GTTTGACCTGTCTCGTGAAAGGCT
TTTATCCCAGTGATATAGCCGTGG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | AATGGAAAGTAACGGGCAGCCC GAGAACAACTATAAGACCACACCA CCCATGCTGGACTCCGACGGTTCT TTCTTCCTTTATAGCAAGCTGACA GTGGATAAATCCAGGTGGCAGCA GGGTAACGTATTCAGTTGCAGTGT CATGCACGAGGCACTCCACAACCA CTATACTCAGAAAAGTCTTTCCCT GAGTCCAGGCAAG |
| SEQ ID 2446 | QVQLQESGGGLVQPGG SLRLSCAASGFTFSSYA MHWVRQAPGKGLEYVS AISSNGGSTYYANSVKG RFTISRDNSKNTLYLQM GSLRAEDMAVYYCARA KFWTYYFDYWGQGTLV TVSSASTKGPSVFPLAP CSRSTSESTAALGCLVK DYFPEPVTVSWNSGAL TSGVHTFPAVLQSSGLY SLSSVTVPSSNFGTQT YTCNVDHKPSNTKVDKT VERKCCVECPPCPAPP VAGPSVFLFPPKPKDTL MISRTPEVTCVVVDVSH EDPEVQFNWYVDGVEV HNAKTKPREEQFNSTFR VVSVLTVVHQDWLNGK EYKCKVSNKGLPAPIEK TISKTKGQPREPQVYTL PPSREEMTKNQVSLTCL VKGFYPSDIAVEWESNG QPENNYKTTPPMLDSD GSFFLYSKLTVDKSRW QQGNVFSCSVMHEALH NHYTQKSLSLSPGK | SEQ ID 2554 | CAGGTGCAGCTGCAGGAGTCGGG GGGAGGCTTGGTCCAGCCTGGGG GGTCCCTGAGACTCTCCTGTGCAG CCTCTGGATTCACCTTCAGTAGCT ATGCTATGCACTGGGTCCGCCAG GCTCCAGGGAAGGGACTGGAATA TGTTTCAGCTATTAGTAGTAATGG GGGTAGCACATATTATGCAAACTC TGTGAAGGGCAGATTCACCATCTC CAGAGACAATTCCAAGAACACGCT GTATCTTCAAATGGGCAGCCTGAG AGCTGAGGACATGGCTGTGTATTA CTGTGCGAGAGCTAAGTTTTGGAC ATACTACTTTGACTACTGGGGCCA GGGAACCCTGGTGACCGTCTCCT CAGCAAGCACAAAAGGTCCTTCAG TGTTCCCTCTGGCACCTTGCTCAC GCAGCACCTCTGAGAGTACAGCC GCCCTGGGCTGCCTGGTAAAGGA CTACTTTCCCGAACCAGTCACTGT GTCCTGGAATAGCGGGCCTTGA CCTCTGGAGTCACACATTTCCAG CTGTACTGCAGTCATCTGGACTCT ACAGCCTGTCCAGTGTGGTCACC GTACCTTCCTCCAACTTTGGCACT CAAACATATACATGTAACGTGGAT CATAAGCCCTCTAACACCAAAGTG GATAAAACTGTGGAGCGTAAGTGT TGTGTCGAGTGTCCTCCTTGTCCT GCTCCTCCTGTGGCAGGCCCATCT GTGTTTCTCTTTCCCCCAAAGCCA AAGGACACTTTGATGATATCCCGG ACCCCTGAGGTGACTTGCGTCGTC GTAGATGTTTCACACGAAGATCCA GAGGTGCAGTTCAACTGGTACGTG GATGGCGTGGAAGTGCATAATGC CAAGACAAAGCCCCGCGAAGAGC AGTTTAATTCCACCTTCCGCGTGG TGTCTGTGCTGACCGTGGTACATC AGGATTGGCTTAACGGTAAGGAGT ACAAGTGCAAGGTGAGTAACAAGG GGCTGCCCGCCCCTATCGAGAAG ACTATCAGTAAAACCAAGGGCCAG CCAAGGGAGCCACAGGTGTACAC ACTTCCACCATCTAGGGAGGAAAT GACAAAGAACCAGGTGAGTTTGAC CTGTCTCGTGAAAGGCTTTTATCC CAGTGATATAGCCGTGGAATGGGA AAGTAACGGGCAGCCCGAGAACA ACTATAAGACCACACCACCCATGC TGGACTCCGACGGTTCTTTCTTCC TTTATAGCAAGCTGACAGTGGATA AATCCAGGTGGCAGCAGGGTAAC GTATTCAGTTGCAGTGTCATGCAC GAGGCACTCCACAACCACTATACT CAGAAAAGTCTTTCCCTGAGTCCA GGCAAG |
| SEQ ID 2447 | QVQLQQWGAGLLKPSE TLSLTCAVYGGSFSGYY WSWIRQPPGKGLEWIG EINHSGSTNYNPSLKSR VTISVDTSKNQFSLKLSS VTAADTAVYYCARGGG SGSYYKRFFDYWGQGT LVTVSSASTKGPSVFPL | SEQ ID 2555 | CAGGTGCAGCTACAGCAGTGGGG CGCAGGACTGTTGAAGCCTTCGG AGACCCTGTCCCTCACCTGCGCTG TCTATGGTGGGTCCTTCAGTGGTT ACTACTGGAGCTGGATCCGCCAG CCCCCAGGGAAGGGGCTGGAGTG GATTGGGGAAATCAATCATAGTGG AAGCACCAACTACAACCCGTCCCT |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | APCSRSTSESTAALGCL | | CAAGAGTCGAGTCACCATATCAGT |
| | VKDYFPEPVTVSWNSG | | AGACACGTCCAAGAACCAGTTCTC |
| | ALTSGVHTFPAVLQSSG | | CCTGAAGCTGAGCTCTGTGACCG |
| | LYSLSSVVTVPSSNFGT | | CCGCGGACACGGCTGTGTATTACT |
| | QTYTCNVDHKPSNTKV | | GTGCGAGAGGCGGTGGTTCGGGG |
| | DKTVERKCCVECPPCP | | AGTTATTATAAGAGGTTCTTTGACT |
| | APPVAGPSVFLFPPKPK | | ACTGGGGCCAGGGAACCCTGGTC |
| | DTLMISRTPEVTCVVVD | | ACCGTCTCCTCAGCAAGCACAAAA |
| | VSHEDPEVQFNWYVDG | | GGTCCTTCAGTGTTCCCTCTGGCA |
| | VEVHNAKTKPREEQFN | | CCTTGCTCACGCAGCACCTCTGAG |
| | STFRVVSVLTVVHQDWL | | AGTACAGCCGCCCTGGGCTGCCT |
| | NGKEYKCKVSNKGLPA | | GGTAAAGGACTACTTTCCCGAACC |
| | PIEKTISKTKGQPREPQV | | AGTCACTGTGTCCTGGAATAGCGG |
| | YTLPPSREEMTKNQVSL | | GGCCTTGACCTCTGGAGTGCACA |
| | TCLVKGFYPSDIAVEWE | | CATTTCCAGCTGTACTGCAGTCAT |
| | SNGQPENNYKTTPPML | | CTGGACTCTACAGCCTGTCCAGTG |
| | DSDGSFFLYSKLTVDKS | | TGGTCACCGTACCTTCCTCCAACT |
| | RWQQGNVFSCSVMHE | | TTGGCACTCAAACATATACATGTAA |
| | ALHNHYTQKSLSLSPGK | | CGTGGATCATAAGCCCTCTAACAC |
| | | | CAAAGTGGATAAAACTGTGGAGCG |
| | | | TAAGTGTTGTGTCGAGTGTCCTCC |
| | | | TTGTCCTGCTCCTCCTGTGGCAGG |
| | | | CCCATCTGTGTTTCTCTTTCCCCC |
| | | | AAAGCCAAAGGACACTTTGATGAT |
| | | | ATCCCGGACCCCTGAGGTGACTT |
| | | | GCGTCGTCGTAGATGTTTCACACG |
| | | | AAGATCCAGAGGTGCAGTTCAACT |
| | | | GGTACGTGGATGGCGTGGAAGTG |
| | | | CATAATGCCAAGACAAAGCCCCGC |
| | | | GAAGAGCAGTTTAATTCCACCTTC |
| | | | CGCGTGGTGTCTGTGCTGACCGT |
| | | | GGTACATCAGGATTGGCTTAACGG |
| | | | TAAGGAGTACAAGTGCAAGGTGAG |
| | | | TAACAAGGGGCTGCCCGCCCCTA |
| | | | TCGAGAAGACTATCAGTAAAACCA |
| | | | AGGGCCAGCCAAGGGAGCCACAG |
| | | | GTGTACACACTTCCACCATCTAGG |
| | | | GAGGAAATGACAAAGAACCAGGT |
| | | | GAGTTTGACCTGTCTCGTGAAAGG |
| | | | CTTTTATCCCAGTGATATAGCCGT |
| | | | GGAATGGGAAAGTAACGGGCAGC |
| | | | CCGAGAACAACTATAAGACCACAC |
| | | | CACCCATGCTGGACTCCGACGGTT |
| | | | CTTTCTTCCTTTATAGCAAGCTGAC |
| | | | AGTGGATAAATCCAGGTGGCAGCA |
| | | | GGGTAACGTATTCAGTTGCAGTGT |
| | | | CATGCACGAGGCACTCCACAACCA |
| | | | CTATACTCAGAAAAGTCTTTCCCT |
| | | | GAGTCCAGGCAAG |
| SEQ ID 2448 | EVQLVQSGAEVRKPGA SVKVSCKASGYTFTSYA ISWVRQAPGQGLEWMG WISAYDGNTNYAQKLQ GRVTMTTDTSTSTAYM EVRSLRSDDTAVYYCAR DGTVRRVVGATTPGNF DYRGQGTLVTVSSASTK GPSVFPLAPCSRSTSES TAALGCLVKDYFPEPVT VSWNSGALTSGVHTFP AVLQSSGLYSLSSVVTV PSSNFGTQTYTCNVDH KPSNTKVDKTVERKCCV ECPPCPAPPVAGPSVFL FPPKPKDTLMISRTPEV TCVVVDVSHEDPEVQF NWYVDGVEVHNAKTKP REEQFNSTFRVVSVLTV VHQDWLNGKEYKCKVS NKGLPAPIEKTISKTKGQ PREPQVYTLPPSREEMT KNQVSLTCLVKGFYPSD IAVEWESNGQPENNYK | SEQ ID 2556 | GAGGTGCAGCTGGTGCAGTCTGG AGCTGAGGTGAGGAAGCCTGGGG CCTCAGTGAAGGTCTCCTGCAAGG CTTCTGGTTACACATTTACCAGTTA TGCCATCAGCTGGGTGCGACAGG CCCCTGGACAAGGGCTTGAGTGG ATGGGGTGGATCAGCGCTTACGA CGGTAACACAAACTATGCACAGAA GCTCCAGGGCAGAGTCACCATGA CCACAGACACATCCACGAGCACA GCCTACATGGAGGTGAGGAGCCT GAGATCTGACGACACGGCCGTGT ATTACTGTGCGAGAGATGGTACGG TCCGAAGGGTAGTGGGAGCTACT ACCCCTGGAAACTTTGACTACAGG GGCCAGGGAACCCTGGTCACCGT CTCCTCAGCAAGCACAAAGGTCC TTCAGTGTTCCCTCTGGCACTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC TTGACCTCTGGAGTGCACACATTT CCAGCTGTACTGCAGTCATCTGGA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | TTPPMLDSDGSFFLYSK LTVDKSRWQQGNVFSC SVMHEALHNHYTQKSL SLSPGK | | CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |
| SEQ ID 2449 | EVQLVQSGGGVVQPGR SLRLSCAASGFTFSSYG MHWRQAPGKGLEWV AVIWYDGSNKYYADSVK GRFTISRDNSKNTLYLQ MNSLRAEDTAVYYCAR DLNRGYCSGGSCFGYW GQGTLVTVSSASTKGPS VFPLAPCSRSTSESTAA LGCLVKDYFPEPVTVSW NSGALTSGVHTFPAVLQ SSGLYSLSSVVTVPSSN FGTQTYTCNVDHKPSN TKVDKTVERKCCVECPP CPAPPVAGPSVFLFPPK PKDTLMISRTPEVTCVV VDVSHEDPEVQFNWYV DGVEVHNAKTKPREEQ FNSTFRVVSVLTVVHQD WLNGKEYKCKVSNKGL PAPIEKTISKTKGQPREP QVYTLPPSREEMTKNQ VSLTCLVKGFYPSDIAVE WESNGQPENNYKTTPP MLDSDGSFFLYSKLTVD KSRWQQGNVFSCSVM HEALHNHYTQKSLSLSP GK | SEQ ID 2557 | GAGGTGCAGCTGGTGCAGTCTGG GGGAGGCGTGGTCCAGCCTGGGA GGTCCCTGAGACTCTCCTGTGCAG CGTCTGGATTCACCTTCAGTAGCT ATGGCATGCACTGGGTCCGCCAG GCTCCAGGCAAGGGGCTGGAGTG GGTGGCAGTTATATGGTATGATGG AAGTAATAAATACTATGCAGACTC CGTGAAGGGCCGATTCACCATCTC CAGAGACAATTCCAAGAACACGCT GTATCTGCAAATGAACAGCCTGAG AGCCGAGGACACGGCTGTGTATTA CTGTGCGAGAGATCTGAATCGAG GATATTGTAGTGGTGGTAGCTGCT TTGGCTACTGGGGCCAGGGAACC CTGGTCACCGTCTCCTCAGCAAGC ACAAAAGGTCCTTCAGTGTTCCCT CTGGCACCTTGCTCACGCAGCAC CTCTGAGAGTACAGCCGCCCTGG GCTGCCTGGTAAAGGACTACTTTC CCGAACCAGTCACTGTGTCCTGGA ATAGCGGGGCCTTGACCTCTGGA GTGCACACATTTCCAGCTGTACTG CAGTCATCTGGACTCTACAGCCTG TCCAGTGTGGTCACCGTACCTTCC TCCAACTTTGGCACTCAAACATATA CATGTAACGTGGATCATAAGCCCT CTAACACCAAAGTGGATAAAACTG TGGAGCGTAAGTGTTGTGTCGAGT GTCCTCCTTGTCCTGCTCCTCCTG TGGCAGGCCCATCTGTGTTTCTCT TTCCCCCAAAGCCAAAGGACACTT TGATGATATCCCGGACCCCTGAGG TGACTTGCGTCGTCGTAGATGTTT CACACGAAGATCCAGAGGTGCAG TTCAACTGGTACGTGGATGGCGTG GAAGTGCATAATGCCAAGACAAAG CCCCGCGAAGAGCAGTTTAATTCC ACCTTCCGCGTGGTGTCTGTGCTG ACCGTGGTACATCAGGATTGGCTT AACGGTAAGGAGTACAAGTGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | | | GTGAGTAACAAGGGGCTGCCCGC CCCTATCGAGAAGACTATCAGTAA AACCAAGGGCCAGCCAAGGGAGC CACAGGTGTACACACTTCCACCAT CTAGGGAGGAAATGACAAAGAACC AGGTGAGTTTGACCTGTCTCGTGA AAGGCTTTTATCCCAGTGATATAG CCGTGGAATGGGAAAGTAACGGG CAGCCCGAGAACAACTATAAGACC ACACCACCCATGCTGGACTCCGAC GGTTCTTTCTTCCTTTATAGCAAGC TGACAGTGGATAAATCCAGGTGGC AGCAGGGTAACGTATTCAGTTGCA GTGTCATGCACGAGGCACTCCACA ACCACTATACTCAGAAAAGTCTTTC CCTGAGTCCAGGCAAG |
| SEQ ID 2450 | QVQLQESGGGLVQPGG SLRLSCAASGFTFSSYA MSWVRQAPGKGLEWV SYISSSGTTIYYADSVKG RFTVSRDNAKNSLYLQ MNSLRAEDTAVYYCAR DYSSSGECFDYWGQGT LVTVSSASTKGPSVFPL APCSRSTSESTAALGCL VKDYFPEPVTVSWNSG ALTSGVHTFPAVLQSSG LYSLSSVVTVPSSNFGT QTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2558 | CAGGTGCAGCTGCAGGAGTCTGG GGGAGGCTTGGTACAGCCGGGG GGTCCCTGAGACTCTCCTGTGCAG CCTCTGGATTCACCTTTAGCAGCT ATGCCATGAGCTGGGTCCGCCAG GCTCCAGGGAAGGGGCTGGAGTG GGTTTCATACATTAGTAGTAGTGG TACTACCATATACTACGCAGACTC TGTGAAGGGCCGATTCACCGTCTC CAGAGACAATGCCAAGAACTCACT GTATCTGCAAATGAACAGCCTGAG AGCCGAGGACACGGCCGTGTATT ACTGTGCGAGGGATTATAGCAGCT CGGGGGAGTGCTTTGACTACTGG GGCCAGGGAACCCTGGTCACCGT TTCAGTGTTCCCTCTGGCACCTTG CTCACGCAGCACCTCTGAGAGTAC AGCCGCCCTGGGCTGCCTGGTAA AGGACTACTTTCCCGAACCAGTCA CTGTGTCCTGGAATAGCGGGGCC CTCCTCAGCAAGCACAAAAGGTCC TTGACCTCTGGAGTGCACACATTT CCAGCTGTACTGCAGTCATCTGGA CTCTACAGCCTGTCCAGTGTGGTC ACCGTACCTTCCTCCAACTTTGGC ACTCAAACATATACATGTAACGTG GATCATAAGCCCTCTAACACCAAA GTGGATAAAACTGTGGAGCGTAAG TGTTGTGTCGAGTGTCCTCCTTGT CCTGCTCCTCCTGTGGCAGGCCC ATCTGTGTTTCTCTTTCCCCCAAAG CCAAAGGACACTTTGATGATATCC CGGACCCCTGAGGTGACTTGCGT CGTCGTAGATGTTTCACACGAAGA TCCAGAGGTGCAGTTCAACTGGTA CGTGGATGGCGTGGAAGTGCATA ATGCCAAGACAAAGCCCCGCGAA GAGCAGTTTAATTCCACCTTCCGC GTGGTGTCTGTGCTGACCGTGGTA CATCAGGATTGGCTTAACGGTAAG GAGTACAAGTGCAAGGTGAGTAAC AAGGGGCTGCCCGCCCCTATCGA GAAGACTATCAGTAAAACCAAGGG CCAGCCAAGGGAGCCACAGGTGT ACACACTTCCACCATCTAGGGAGG AAATGACAAAGAACCAGGTGAGTT TGACCTGTCTCGTGAAAGGCTTTT ATCCCAGTGATATAGCCGTGGAAT GGGAAAGTAACGGGCAGCCCGAG AACAACTATAAGACCACACCACCC ATGCTGGACTCCGACGGTTCTTTC TTCCTTTATAGCAAGCTGACAGTG GATAAATCCAGGTGGCAGCAGGG TAACGTATTCAGTTGCAGTGTCAT GCACGAGGCACTCCACAACCACTA TACTCAGAAAAGTCTTTCCCTGAG TCCAGGCAAG |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| SEQ ID 2451 | EVQLVQSGGGVVQPGR SLRLSCAASGFTFSSYG MHWVRQAPGKGLEWV AVIWYDGSNKYYADSVK GRFTISRDNSKNTLYLQ MNSLRAEDTAVYYCAR DQAAMVGYFDYWGQG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN STFRVVSVLTVVHQDWL NGKEYKCKVSNKGLPA PIEKTISKTKGQPREPQV YTLPPSREEMTKNQVSL TCLVKGFYPSDIAVEWE SNGQPENNYKTTPPML DSDGSFFLYSKLTVDKS RWQQGNVFSCSVMHE ALHNHYTQKSLSLSPGK | SEQ ID 2559 | GAGGTGCAGCTGGTGCAGTCTGG GGGAGGCGTGGTCCAGCCTGGGA GGTCCCTGAGACTCTCCTGTGCAG CGTCTGGATTCACCTTCAGTAGCT ATGGCATGCACTGGGTCCGCCAG GCTCCAGGCAAGGGGCTGGAGTG GGTGGCAGTTATATGGTATGATGG AAGTAATAAATACTATGCAGACTC CGTGAAGGGCCGATTCACCATCTC CAGAGACAATTCCAAGAACACGCT GTATCTGCAAATGAACAGCCTGAG AGCCGAGGACACGGCTGTGTATTA CTGTGCGAGAGATCAGGCAGCTAT GGTAGGCTACTTTGACTACTGGGG CCAGGGAACCCTGGTCACCGTCT CCTCAGCAAGCACAAAAGGTCCTT CAGTGTTCCCTCTGGCACCTTGCT CACGCAGCACCTCTGAGAGTACA GCCGCCCTGGGCTGCCTGGTAAA GGACTACTTTCCCGAACCAGTCAC TGTGTCCTGGAATAGCGGGGCCTT GACCTCTGGAGTGCACACATTTCC AGCTGTACTGCAGTCATCTGGACT CTACAGCCTGTCCAGTGTGGTCAC CGTACCTTCCTCCAACTTTGGCAC TCAAACATATACATGTAACGTGGA TCATAAGCCCTCTAACACCAAAGT GGATAAAACTGTGGAGCGTAAGTG TTGTGTCGAGTGTCCTCCTTGTCC TGCTCCTCCTGTGGCAGGCCCATC TGTGTTTCTCTTTCCCCCAAAGCC AAAGGACACTTTGATGATATCCCG GACCCCTGAGGTGACTTGCGTCG TCGTAGATGTTTCACACGAAGATC CAGAGGTGCAGTTCAACTGGTACG TGGATGGCGTGGAAGTGCATAATG CCAAGACAAAGCCCCGCGAAGAG CAGTTTAATTCCACCTTCCGCGTG GTGTCTGTGCTGACCGTGGTACAT CAGGATTGGCTTAACGGTAAGGAG TACAAGTGCAAGGTGAGTAACAAG GGGCTGCCCGCCCCTATCGAGAA GACTATCAGTAAAACCAAGGGCCA GCCAAGGGAGCCACAGGTGTACA CACTTCCACCATCTAGGGAGGAAA TGACAAAGAACCAGGTGAGTTTGA CCTGTCTCGTGAAAGGCTTTTATC CCAGTGATATAGCCGTGGAATGG GAAAGTAACGGGCAGCCCGAGAA CAACTATAAGACCACACCACCCAT GCTGGACTCCGACGGTTCTTTCTT CCTTTATAGCAAGCTGACAGTGGA TAAATCCAGGTGGCAGCAGGGTAA CGTATTCAGTTGCAGTGTCATGCA CGAGGCACTCCACAACCACTATAC TCAGAAAAGTCTTTCCCTGAGTCC AGGCAAG |
| SEQ ID 2452 | QVTLKESGGGVVQPGR SLRLSCAASGFIFSNYAI HWVRQAPGKGLEWVA VISYDGSNKYYADSVKG RFTISRDNSKNTLYLQM NSLRAEDTAVYYCARTF AGYSSKLGYFDLWGRG TLVTVSSASTKGPSVFP LAPCSRSTSESTAALGC LVKDYFPEPVTVSWNS GALTSGVHTFPAVLQSS GLYSLSSVVTVPSSNFG TQTYTCNVDHKPSNTKV DKTVERKCCVECPPCP APPVAGPSVFLFPPKPK DTLMISRTPEVTCVVVD VSHEDPEVQFNWYVDG VEVHNAKTKPREEQFN | SEQ ID 2560 | CAGGTCACCTTGAAGGAGTCTGG GGGAGGCGTGGTCCAGCCTGGGA GGTCCCTGAGACTCTCCTGTGCAG CCTCTGGATTCATCTTCAGTAACTA TGCTATACACTGGGTCCGCCAG GCTCCAGGCAAGGGGCTGGAGTGG GTGGCAGTTATATCATATGATGGA AGTAATAAATACTACGCAGACTCC GTGAAGGGCCGATTCACCATCTCC AGAGACAATTCCAAGAACACGCTG TATCTGCAAATGAACAGCCTGAGA GCTGAGGACACGGCTGTGTATTAC TGTGCGAGGACTTTTGCGGGGTAT AGCAGCAAACTGGGGTACTTCGAT CTCTGGGGCCGTGGCACCCTGGT CACCGTCTCCTCAGCAAGCACAAA AGGTCCTTCAGTGTTCCCTCTGGC ACCTTGCTCACGCAGCACCTCTGA |

TABLE 41-continued

Anti-CLEC2D IgG2 antibody amino acid and DNA sequence

| SEQ ID | VH + CH IgG2 aa | SEQ ID | VH + IgG2 DNA |
|---|---|---|---|
| | STFRVVSVLTVVHQDWL<br>NGKEYKCKVSNKGLPA<br>PIEKTISKTKGQPREPQV<br>YTLPPSREEMTKNQVSL<br>TCLVKGFYPSDIAVEWE<br>SNGQPENNYKTTPPML<br>DSDGSFFLYSKLTVDKS<br>RWQQGNVFSCSVMHE<br>ALHNHYTQKSLSLSPGK | | GAGTACAGCCGCCCTGGGCTGCC<br>TGGTAAAGGACTACTTTCCCGAAC<br>CAGTCACTGTGTCCTGGAATAGCG<br>GGGCCTTGACCTCTGGAGTGCAC<br>ACATTTCCAGCTGTACTGCAGTCA<br>TCTGGACTCTACAGCCTGTCCAGT<br>GTGGTCACCGTACCTTCCTCCAAC<br>TTTGGCACTCAAACATATACATGTA<br>ACGTGGATCATAAGCCCTCTAACA<br>CCAAAGTGGATAAAACTGTGGAGC<br>GTAAGTGTTGTGTCGAGTGTCCTC<br>CTTGTCCTGCTCCTCCTGTGGCAG<br>GCCCATCTGTGTTTCTCTTTCCCC<br>CAAAGCCAAAGGACACTTTGATGA<br>TATCCCGGACCCCTGAGGTGACTT<br>GCGTCGTCGTAGATGTTTCACACG<br>AAGATCCAGAGGTGCAGTTCAACT<br>GGTACGTGGATGGCGTGGAAGTG<br>CATAATGCCAAGACAAAGCCCCGC<br>GAAGAGCAGTTTAATTCCACCTTC<br>CGCGTGGTGTCTGTGCTGACCGT<br>GGTACATCAGGATTGGCTTAACGG<br>TAAGGAGTACAAGTGCAAGGTGAG<br>TAACAAGGGGCTGCCCGCCCCTA<br>TCGAGAAGACTATCAGTAAAACCA<br>AGGGCCAGCCAAGGGAGCCACAG<br>GTGTACACACTTCCACCATCTAGG<br>GAGGAAATGACAAAGAACCAGGT<br>GAGTTTGACCTGTCTCGTGAAAGG<br>CTTTTATCCCAGTGATATAGCCGT<br>GGAATGGGAAAGTAACGGGCAGC<br>CCGAGAACAACTATAAGACCACAC<br>CACCCATGCTGGACTCCGACGGTT<br>CTTTCTTCCTTTATAGCAAGCTGAC<br>AGTGGATAAATCCAGGTGGCAGCA<br>GGGTAACGTATTCAGTTGCAGTGT<br>CATGCACGAGGCACTCCACAACCA<br>CTATACTCAGAAAAGTCTTTCCCT<br>GAGTCCAGGCAAG |

Antibody Mediated Cytotoxicity

Figure 19C:
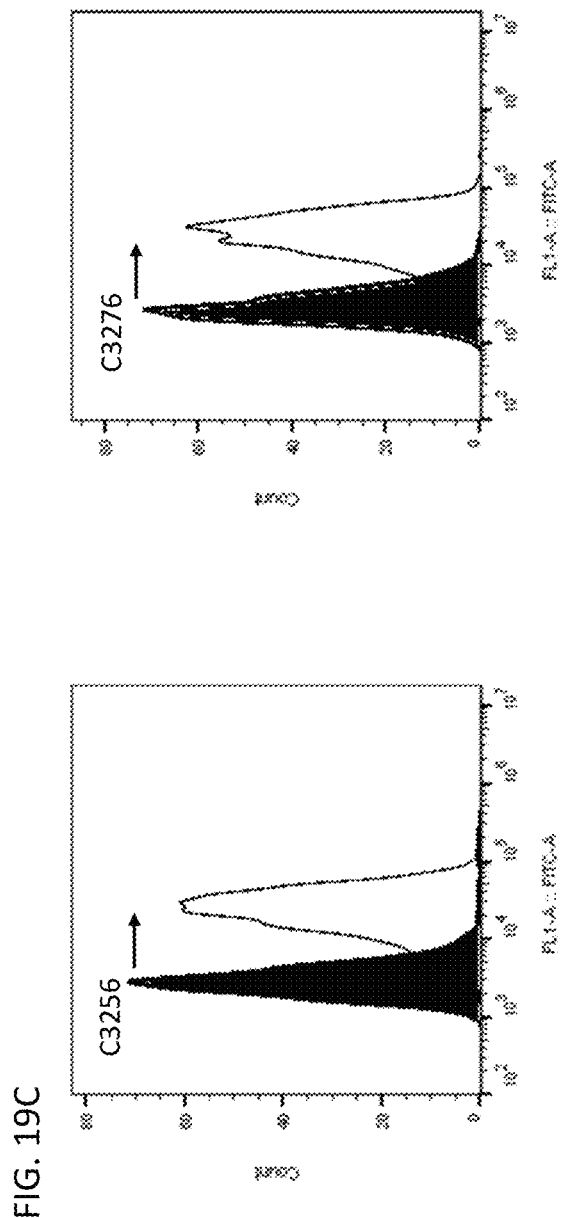

Post purification, anti-CLEC2D antibody clones were assessed for cell surface binding on C4548 cells using flow cytometry. As can be seen from FIG. 19C, both clones with IgG4 isotype, exhibited binding towards surface expressed CLEC2D antigen with ~4-8 fold higher MFI when compared with control un-transfected CHO cell.

In order to evaluate functionality of isotype variants, PC3 cells were labelled with Efluor as per the manufacturer's protocol and were seeded at a density of $0.04 \times 10^6$ in 20% DMEM in 24 well plates. After 24 hours, freshly isolated PBMCs were added in T:E of 1:5 and novel monoclonal anti-CLEC2D antibodies C3276, C3256, C3452, and C4608 were added at 100 μg/ml in the assay reaction of 0.5 ml and incubated for 14 hours. Supernatant was collected from 24 well plate and adherent cells were trypsinized and collected in 1.5 ml tubes. Reaction mixture was incubated with sytox green (15 nM) for 20 min and fluorescence was detected in flow cytometer. Percent specific cell death was determined by subtracting the percent cell death of control from the test samples.

Figure 19D:
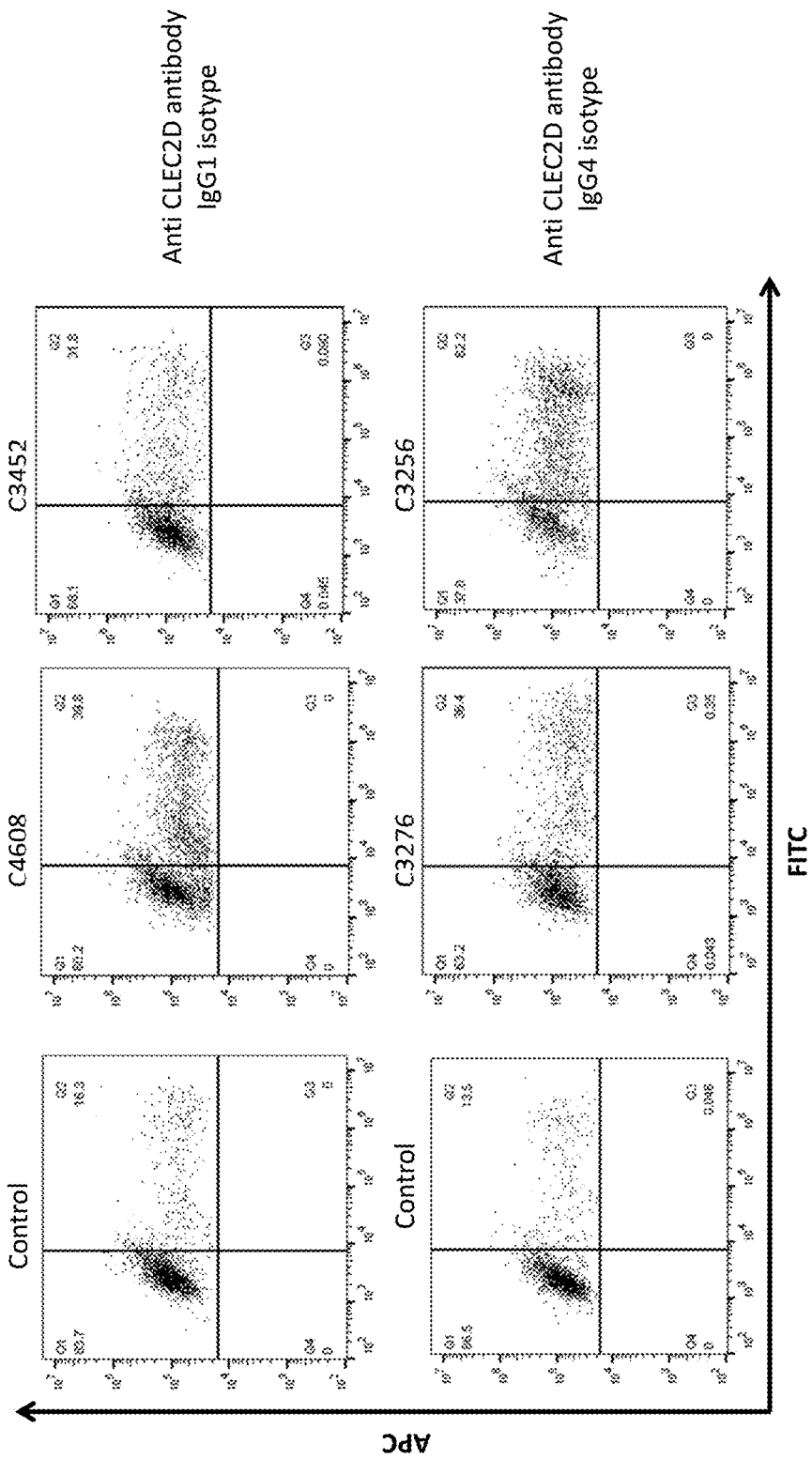

As can be seen from FIG. 19D, for C3276, IgG4 variant and C4608 IgG1 variant exhibited similar percentage of cytotoxicity towards PC3 cells. Taken together, both IgG1 and IgG4 variants (treated at 100 μg/ml) showed anti-tumor activity towards PC3 cells signifying an engagement of both CD16 dependent target cell death and also killing of target cells via blocking of CLEC2D and CD161 interaction, in turn suggesting involvement of multiple pathways, probably functions independent of ADCC mechanism, to rapidly kill the tumour cells. In addition, different isotype format of the said antibody, could potentially pave new line of treatment for specific disease, not limiting to, prostate cancer.

Impact of Anti-CLEC2D Antibody with Modified Glycosylation on Cytotoxicity

The monoclonal antibody based biotherapeutics function through effective recognition of the antigenic epitopes on target cells as well as the antibody effector functions, as an outcome of formation of immune complexes. In recent times, antibody effector function has gained considerable interest towards improving efficacy of the said class of biotherapeutics. Antibody dependent Cellular Cytotoxicity (ADCC) improves clinical efficacy of therapeutic antibodies, the effect is more pronounced in case of anticancer antibodies as exemplified in studies involving allelic polymorphism of leucocyte receptors (FcγR) in patients. Recently, an elegant study with homogeneous IgG glycoforms developed through chemo-enzymatic methods revealed antibody sialylation negatively impacts ADCC in the context of core fucosylation but not in case of nonfucosylated antibody. Multiple studies reported that completely nonfucosylated monoclonal antibody has significantly increased Fc affinity to FcγRIII and thereby improving antibody ADCC function by many folds, in vitro and in vivo.

With the advent next generation monoclonal antibody drugs against immune oncology targets, where innate immune system is mobilized to tumor microenvironment, engaging NK cell effector functions becomes immensely important. Any such antibody with improved ADCC functionality recognizing epitopes on tumor cells has the potential to exert more inhibitory effects on tumor cell survival and hence tumor progression. In this context, controlling ADCC function of monoclonal antibody therapeutics helps balancing the optimal effector function to deleterious cytokine release.

Afucosylated Anti CLEC2D Antibody Expression:

Talen Fut8 gene knockout cell line was developed in GS negative CHO cell line. This cell line was sequence verified for FUT8 gene knock-out and was coded as C2899. C0694 (HC and LC vectors) and C2685 (HC and LC vectors) were transfected in this cell line. Antibiotic selection was performed, Minipools and single cell clones were developed from this cell line which expresses afucosylated anti-CLEC2D antibody. Afucosylated antibodies were tested for cell surface antigen binding on C4548 cells by flow-cytometry and on target cells by confocal imaging.

C2899 Cell Transfection to Express Novel Anti-CLEC2D Monoclonal Antibody Clones Transfection:

C2899 cells were transfected with C0694 and C2685 heavy chain and light chain vectors. Cell count and viability data was collected using Vi-cell XR automated cell counter, Beckman coulter. Transfection was carried out as per manufacturer's protocol Lipofectamine® LTX Reagent with PLUS Reagent. Required volume of cell suspension was centrifuged at 1400 RPM for 4 mins and re-suspended in specified volume of OPTIMEM I in 125 ml shake flask. Transfection mix was prepared as described before. C2899 cells transfected with C0694 HC and LC vectors were known as C3234 whereas C2899 cells transfected with C2685 HC and LC vectors were known as C4335.

Generation of Stable Cell Lines Expressing Afucosylated Anti-CLEC2D Antibody:

Antibiotic Selection:

Antibiotic selection was initiated after transfection at >80% cell viability. Cell suspension was centrifuged at 1400 RPM for 4-5 mins. Pellet was re-suspended in complete Power CHO2 growth media and concentration of Puromycin Dihydrochloride was adjusted to 2 µg/1×10^6 cells. Antibiotic selection was carried out on every 2nd or 3rd day.

Repeat Transfection of Stable Pool:

Cell count was taken using Vi-cell XR. Cells were subcultured before the transfection. Two more sequential transfections were performed as mentioned previously. On completion of three rounds of transfection the pool was designated as R3 stable pool.

Minipool Plating:

Minipools were generated by serial dilution method. Continuously growing culture of cell line was subcultured at 0.5 million cells/ml in 30 ml complete PowerCHO 2 growth media with 2 mM glutamax, 1 to 2 days before plating. Cell count and viability data was collected using Vi-cell XR. Serial dilution of the cell suspension was carried out in complete PowerCHO2 growth media at 1:10 ratio. Cells were seeded at a density of 10 cells/well in a 96 well plate in 200 µl volume per well in cloning media. These mini-pools were maintained at 37° C. Temperature in a humidified 5% CO2 incubator.

Screening of Mini-Pools and Amplification:

Mini-pools were screened by flow cytometry wherein binding to C4548 cells was estimated. Minipools were ranked based on cell surface binding. Minipools selected from flow cytometry screening were amplified from 96 well plate to 24 well plate and maintained at 37° C., humidified condition in a 5% CO2 incubator. These were further amplified from 24 well plate to one well of 6 well plate. After cells were confluent mini-pools were amplified from one well of 6 well plate to a 50 ml bioreactor tube or 125 ml Erlenmeyer shake flask with 25-30 ml growth media and maintained at 37° C., humidified condition in a 5% CO2 incubator, 120-200RPM.

Single Cell Cloning

Single cells were generated by serial dilution method. Continuously growing culture of selected mini-pool was subcultured at 1 million cells/ml in 30 ml complete Power-CHO 2 growth media with 2 mM glutamax, 1-2 day before cloning. Cell count and viability data was collected using Vi-cell XR. Serial dilution of the cell suspension was carried out in complete powerCHO2 growth media at 1:10 ratio. Cells were seeded at a density of 0.5 cells/well in a 96 well plate and maintained at 37° C. Temperature in a humidified 5% CO2 static incubator. Plates were scanned by using CloneSelect Imager (Molecular Devices) for monoclonality report generation from day zero to day ten. The clonal population was confirmed from the day zero image of entire well and the monoclonality report generated by CloneSelect Imager. Passage number was P(x+0). Single cell clones were coded with four digit random numbers. The Single cell clones were amplified to 24 well plates after cells were confluent. Passage number was P(x+1).

Screening of Single Cell Clones and Clone Amplification:

Cell surface binding assay was performed to estimate antibody in cell culture supernatant and to rank the clones. Single cell clones showing higher binding on C4548 cell surface expressed CLEC2D antigen were amplified from 24 to 6 well. Passage number was (x+2). This was followed by amplification in 3 wells of 6 well plate. Passage number was (x+3). The clones were further amplified to bioreactor tubes or Erlenmeyer flasks. RCB vials were prepared for the clones.

Culture Harvest for Protein Purification:

Cells were seeded at a density of approximately $0.3 \times 10^6$ cells/ml in 30-100 ml Complete power CHO2 growth media and cultured for 6 days in 37° C., humidified condition in a 5% CO2 incubator with 120 RPM rotation. 20% v/v media top-up was given with complete power CHO2 growth media on 3rd or 4th day. Supernatants were harvested by centrifuging the entire cell suspension at 1400-2000 RPM for 10 mins. The supernatants were collected and subjected to purification by protein-A affinity chromatography.

Cell Surface Binding Assay by Flow-Cytometry:

CHO cells were transiently transfected with CLEC2D surface expression vector. Surface expression was optimum on day 4 to day 5 on transfected cells. These cells were coded as C4548. Cell count was taken by Vi-cell XR automated cell counter. CHO and C4548 cells were centrifuged at 1000-1400 rpm for 4-5 minutes. The pellet was re-suspended in 1 ml DPBS. 50,000 cells were aliquoted in each well of a 96 well plate. 1-5 µg of purified antibody samples and reference control was added to each well and incubated for 40-60 minutes at room temperature (25° C.). The plate was centrifuged at 1000-1400 rpm for 4-5 minutes, the supernatant was aspirated and cells were washed with 0.1% BSA in DPBS. 2.5 ml of 2% BSA was diluted to 50 ml with DPBS. Goat anti human IgG FITC conjugate was used as secondary antibody. 1:100 dilution of secondary antibody was prepared in DPBS and 100 µl was added to each well. The plate was incubated for 30 minutes at room temperature (25° C.) in dark. The cells were washed with 0.1% BSA and re-suspended in 100 µl of 2% BSA. Samples were analyzed by flow-cytometry.

Binding of test sample supernatant on un-transfected CHO cells was estimated and used for calculation of specific binding on C4548 cell surface using following formula:

$$\text{Fold change in } MFI = \frac{\text{Median } FITC\text{-}A \text{ of test sample on } CHO \text{ cells}}{\text{Median } FITC\text{-}A \text{ of test sample on } C4548 \text{ cells}}$$

Figure 19E:
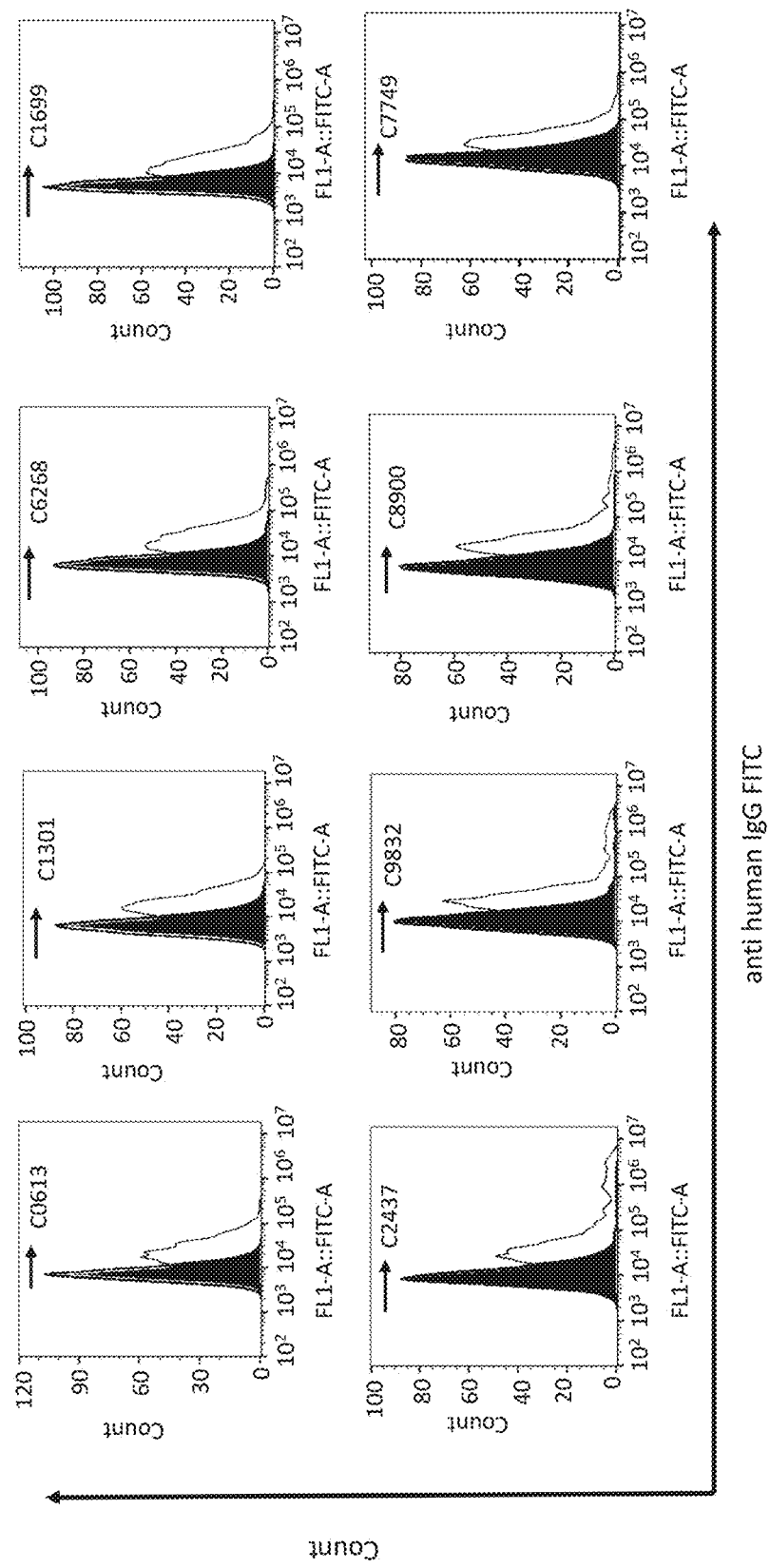

Purified anti-CLEC2D antibody from stable cell clones were firstly assessed for cell surface binding on C4548 cells through flow cytometry, experimentation for flow cytometry based binding studies remains similar as described in Example 5, Section: Cell surface binding assay: through Flow Cytometry and Confocal Microscopy. As can be seen from FIG. 19E, all clones as exemplified by C0613, C1301, C6268, C1699, C2437, C9832, C8900 and C7749, exhibited differential binding towards surface expressed CLEC2D antigen with ~2-10 fold higher MFI when compared with control, which is un-transfected CHO cell.

Cytotoxicity with Afucosylated Anti-CLEC2D Antibody

Confirmed afucosylated anti-CLEC2D mono clonal antibodies were used subsequently for cytotoxicity experiments and effect of glycosylation was compared with fucosylated anti-CLEC2D antibodies.

Herein, PC3 cells were labelled with Efluor as per the manufacturer's protocol and were seeded at a density of $0.04 \times 10^6$ in 20% DMEM in 24 well plates. After 24 hours, freshly isolated NK cell was added in T:E of 1:1. Novel monoclonal anti-CLEC2D antibody C5511 (100 μg/ml) and afucosylated mabs C7749, C8800 and C9832 were added at 20 μg/ml in the assay reaction of 0.5 ml and incubated for 14 hours. Supernatant was subsequently collected from 24 well plate followed by trypsinization of adherent cells. Reaction mixture was incubated with sytox green (15 nM) for 20 min and fluorescence signal was detected using flow cytometer. Percent specific cell death was determined by subtracting the percent cell death of control from the test samples.

Figure 19F:
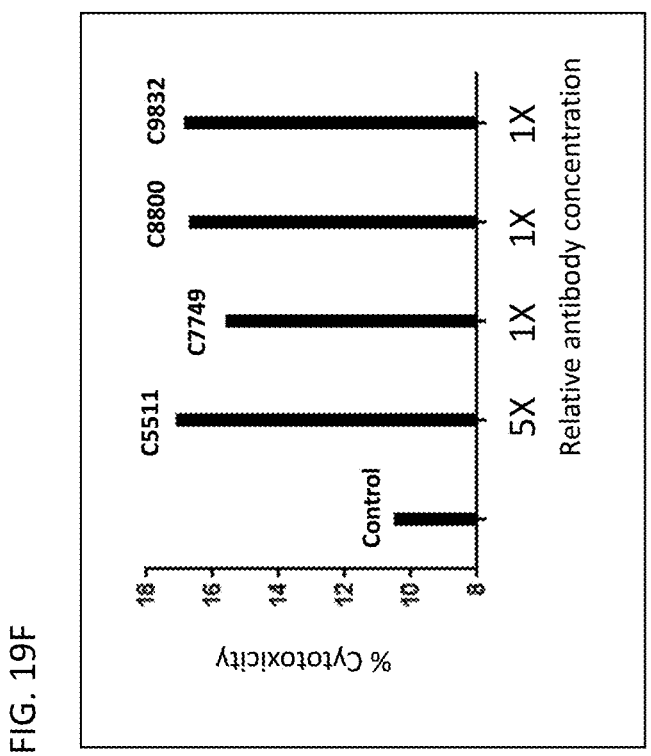

FIG. 19F depicts the impact of fucsylation on Anti-CLEC2D antibody mediated cytotoxicity as assessed through killing of PC3 cells. As mentioned before, afucosylated Anti-CLEC2D antibodies were used at a concentration that is 5 times lower than fucosylated antibody i.e., C5511. Observed cytotoxicity suggests that afucosylated anti-CLEC2D antibody is at least 5 times more effective when compared with the fucosylated anti-CLEC2D antibody. Thereby, the said and described version i.e., afucosylated anti-CLEC2D antibodies could be used as an efficient alternative treatment/therapy option to achieve increased clinical efficacy.

Taken together, functional efficiency of anti-CLEC2D monoclonal antibodies could be ADCC independent, as seen in functionality for said antibody in IgG4 isotype format, while afucosylated version of anti-CLEC2D antibody elicits an efficient ADCC mediated target killing, which in turn elaborates/expands about/on the functional and application related versatility in therapeutic space.

Complement Dependent Cytotoxicity

Complement-dependent cytotoxicity, or CDC, is a well-known mechanism through which antibodies lyse the unwanted target by activating a cascade of complement-related reactions. Usually IgG1 and IgG3, elicits CDC killing effects via binding its Fc region to serum complement components, particularly C1q. Following complicated enzyme activations and cleavage events, involving over 20 highly regulated elements, it will eventually lead to the formation of membrane attacking complex (MAC), thereby target cell destruction.

Specific example details on experimentation wherein 50 μL of target cell suspension (PC3 and Ramos) containing $5 \times 10^4$ cells were added to each well of the 96-well assay plate. 50 μL of different concentrations of C5511 antibody (200, 40, 0.4, 0.04 μg/mL) dilution was added to the plate to start the reaction. The plate was shaken for 30 seconds. Baby rabbit complement was then diluted (1:20) in cell medium, and 50 μL was added to the appropriate wells. Following shaking for 30 seconds, the plate was incubated at 37° C., 5% CO2 for 120 minutes. The plate was then removed from the 37° C. incubator and allowed to cool to room temperature (RT) for 15 minutes, and then add 25 μL of warm Risazurin solution and incubate overnight (16-20 hrs) at 37° C., 5% CO2 incubator. The plate was then removed from the 37° C. incubator and allowed to cool to room temperature (RT) for 15 minutes, and then read plate in fluorescence mode (excitation 530 and emission 590) using the Synergy HT BIOTEK micro plate reader.

Figure 19G:
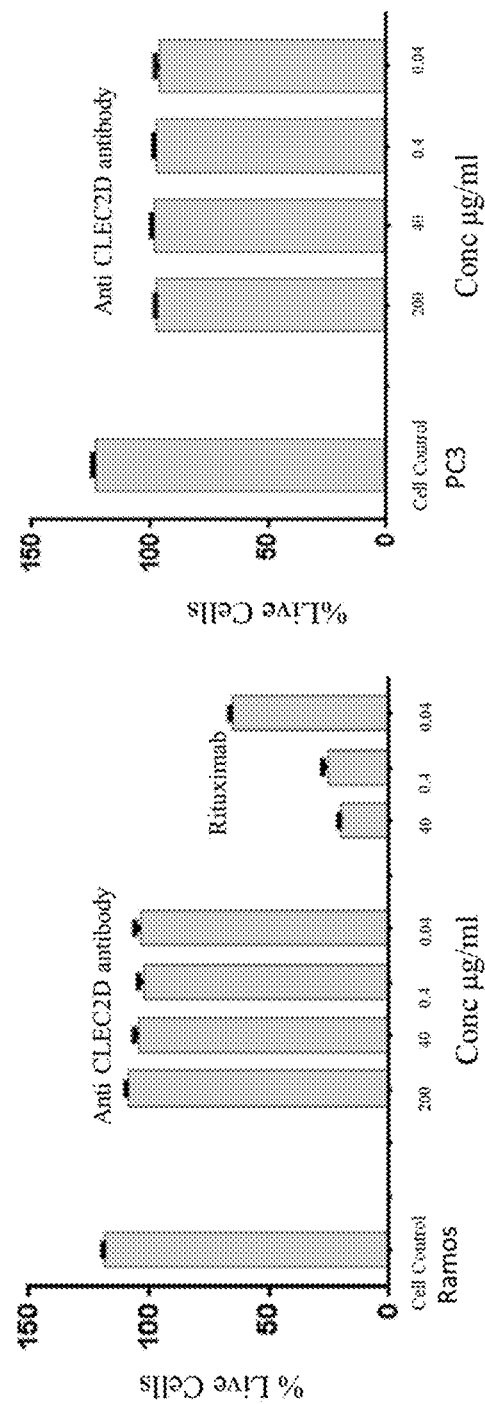

The data obtained from both Ramos and PC3 cell line suggests that anti-CLEC2D antibody does not exhibits its cell killing mechanism through CDC pathway as shown in FIG. 19G.

Example 7: In Vivo Mouse Efficacy Studies with Anti-CLEC2D Monoclonal Antibody

In Vivo Mouse Efficacy Studies

Figure 20A:
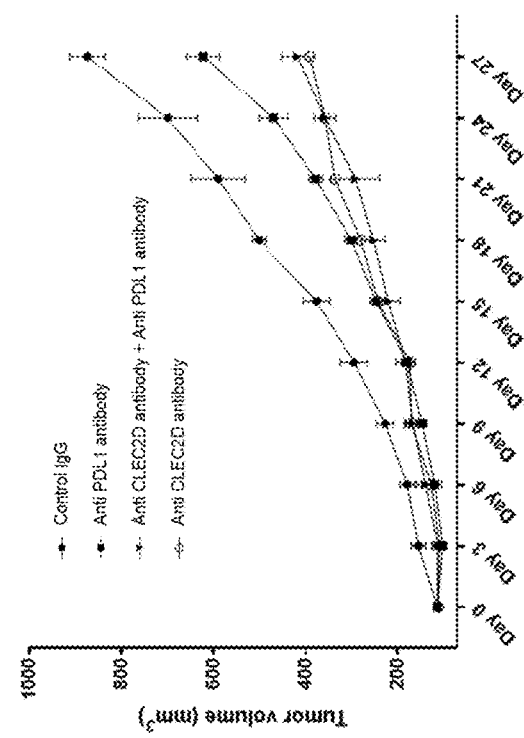
Figures 20B, 20C:
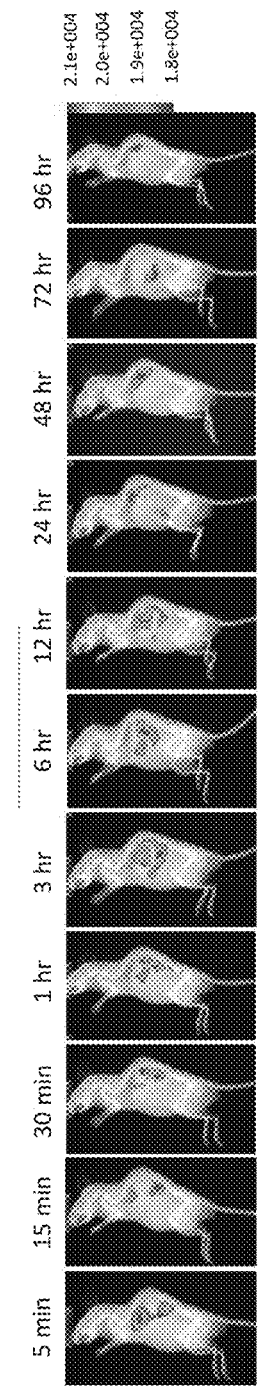
Figure 20D:
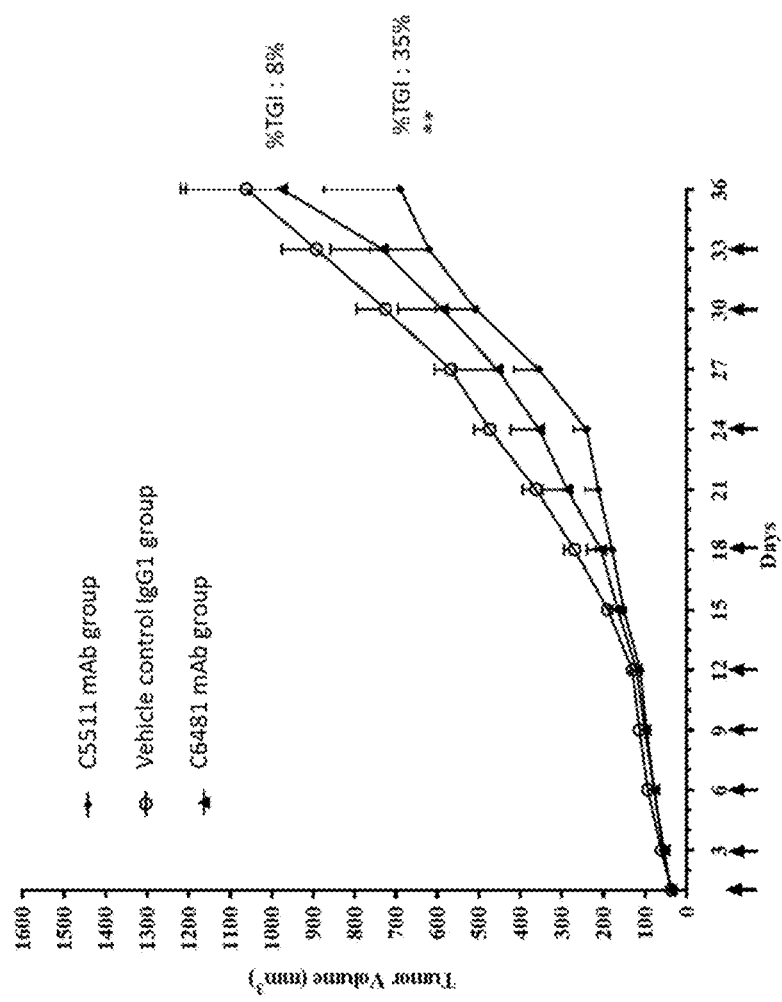
Figure 20E:
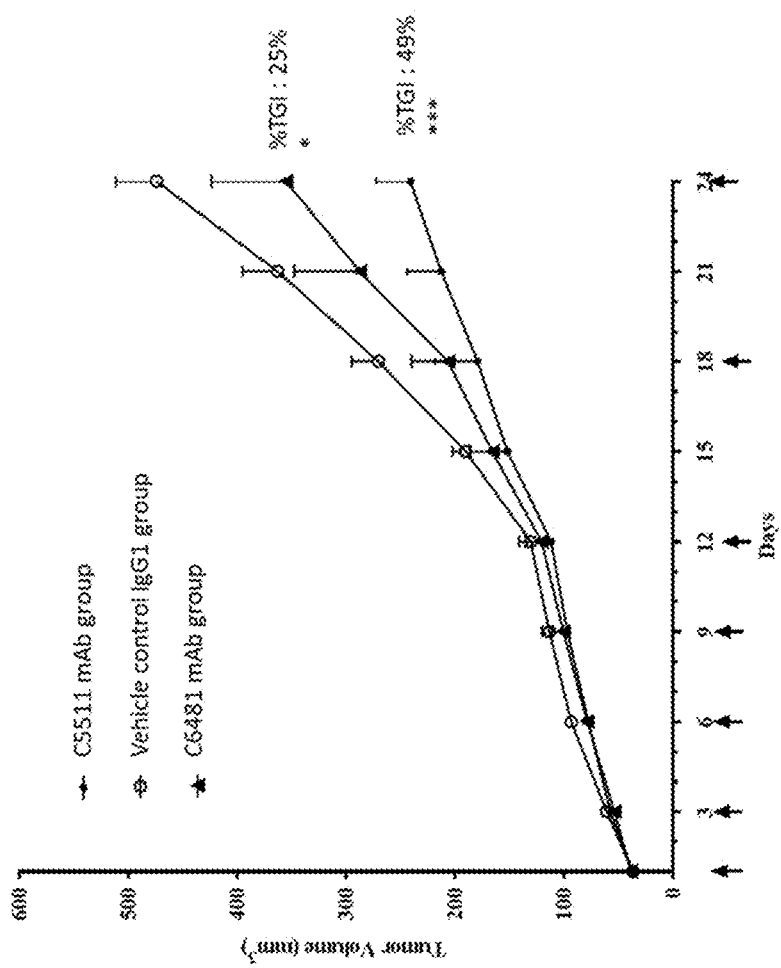
Figure 20F:
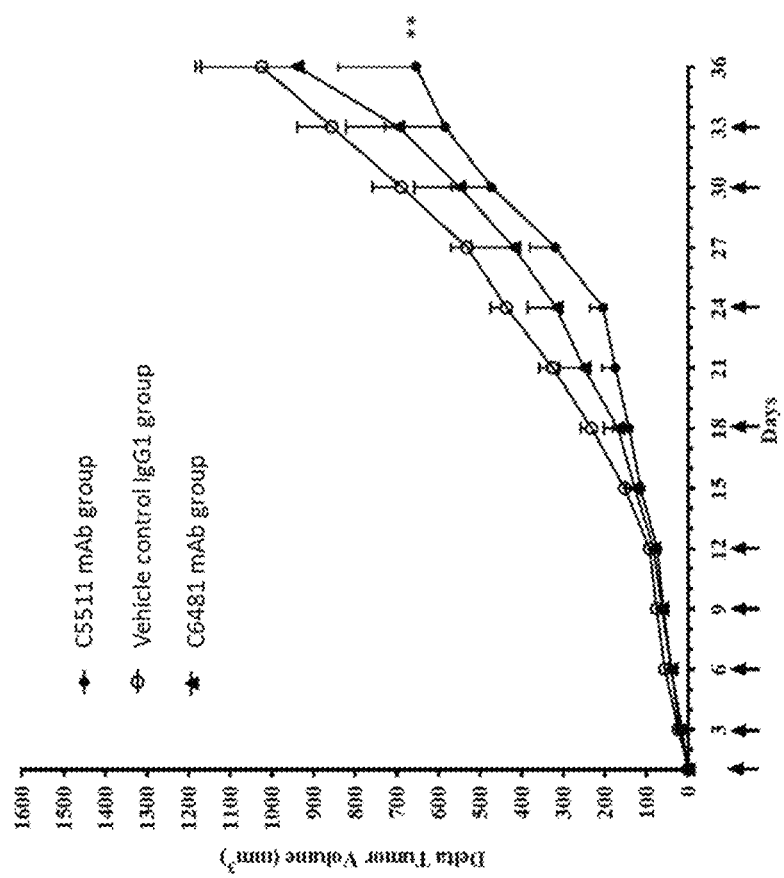
Figure 20G:
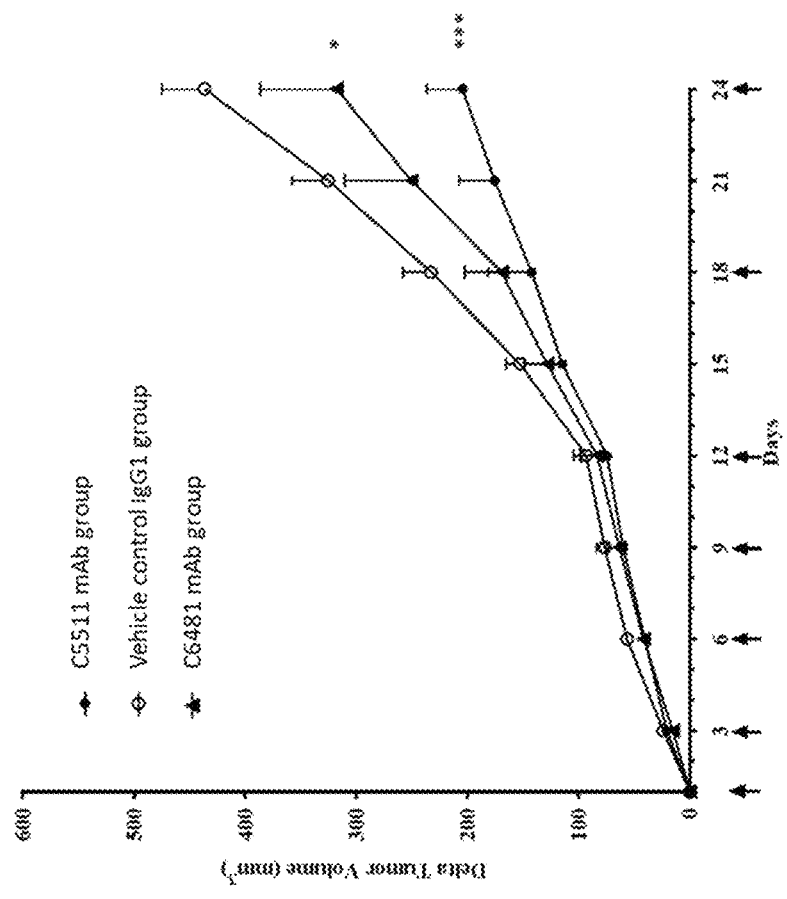

During the development of therapeutic monoclonal antibodies (mAbs), a strategy for early identification of candidate mAbs with the greatest likelihood of success in the clinic is needed to avoid costly late-stage failures related to inadequate exposure, toxicity or lack of efficacy. Early screening and optimization of mAbs focus on characteristics such as affinity, potency and stability for selection of lead constructs, while confirmation on in vivo efficacy are typically required The anticancer activity of anti-CLEC2D monoclonal antibody was evaluated in huNOG-EXL mice bearing subcutaneous PC3 tumor xenografts (FIGS. 20A and 20B). The procedure relies on super immune-deficient hGM-CSF/hIL3 transgenic-NOG mice, which upon engraftment with human hematopoietic stem cells, results in human-like immune system (lymphoid & myeloid lineage of human origin). This model enabled an efficacy study of the key innate mechanisms involved in the function of immune-therapy agents. The study was conducted for a period of 4-5 weeks with regular observation of tumor volume and body weight. The study was carried out in accordance with Institutional Animal Ethics Committee (IAEC).

All animals were kept for acclimatization for a period of about 5-7 days before initiation of the experiment. Animals were housed group wise (5 animals per cage) in IVCs and autoclaved corncob was used as the bedding material. Animals were maintained in a controlled environment with 22±3° C. temperature, 50±20% humidity, a light/dark cycle of 12 hours each and 15-20 fresh air changes per hour. The animals were fed, ad libitum, with certified Irradiated Laboratory Rodent Diet.

| | |
|---|---|
| Species | Mus musculus |
| Strain | huNOGEXL |

-continued

| | |
|---|---|
| Source | Taconic Biosciences |
| Sex | Male |
| Age | 5-6 weeks |
| Body weight | 19-21 g |
| Cancer cell line | PC3 (Human prostate adenocarcinoma) |
| Cell inoculation density | $5 \times 10^6$ cells/animal |
| Study initiation | Tumor volume ($\approx$100 mm$^3$) |
| Duration of the study | 4-5 weeks |
| Test item | Anti-CLEC2D antibody clones, IgG1 control monoclonal antibody, Check point monoclonal antibody |
| Dose & Dosing schedule | 10 mg/kg, 4 intraperitoneal dosing-once every 7 days |
| Route of dosing | Intraperitoneal |
| Tumor volume measurement | Once every three days |
| Body weight measurement | Once every three days |

All procedures were performed in a laminar flow hood following sterile techniques. PC-3 (Human prostate adenocarcinoma) cells with a viability of >90% was chosen for the study. Around 5×10$^6$ cells were re-suspended in 200 µl of serum free media containing 50% of matrigel kept in ice. Male huNOG-EXL mice housed in Individually Ventilated Cages (IVCs) were used for the study. The PC-3 cell line was propagated into the animals by injecting the cells subcutaneously in the right flank region of the animals. The implanted area was monitored for growth of tumor. Once the tumor attained palpable stage and required volume (Mean tumor volume 115 mm$^3$), animals were randomized and dosing was initiated with anti-CLEC2D monoclonal antibodies, the IgG1 control monoclonal antibody and check point monoclonal antibody. Antibodies were administered intraperitoneally. The dose of each individual animal was adjusted based on its body weight.

The primary objective of the study was to evaluate the antitumor activity of anti-CLEC2D monoclonal antibodies. In addition to the efficacy of the anti-CLEC2D antibody clones alone, experiments were carried out for combination treatment with a check point monoclonal antibody against PDL1 antigen. In huNOG-EXL mice bearing PC-3 tumor xenograft, animal body weight, clinical signs and tumor volume were recorded once every three days throughout the experimental period. The study was constituted with following arms as described in Table 42:

TABLE 42

| SI No | Monoclonal antibody | Dosage | Frequency of treatment |
|---|---|---|---|
| Arm 1 | Control human IgG1 | 10 mg/kg | Once a week |
| Arm 2 | anti-CLEC2D mAb clone 1 | 10 mg/kg | Once a week |
| Arm 3 | anti-CLEC2D clone 2 | 10 mg/kg | Once a week |
| Arm 4 | Anti PDL1 mAb | 10 mg/kg | Once a week |
| Arm 5 | anti-CLEC2D clone 1 + Anti PDL1 mAb | 5 mg/kg of anti-CLEC2D clone 1 + 5 mg/kg of Anti PDL1 mAb | Once a week |

Animals in "Arm 1" revealed progressive tumor growth during the study period. Tumor growth inhibition was observed in all other experimental arms. Individual body weight was measured once every three days during the study period. The percentage change in body weight of individual mouse was calculated and recorded. Animals were observed for visible clinical signs every day during the study period. The tumor volume was determined by two-dimensional measurement with a digital Vernier calliper on the day of randomization (Day 0) and then once every three days (i.e., on the same days when body weight was taken). Using a Vernier calliper the length (L) and width (W) of the tumor was measured. Tumor volume (TV) was calculated using the following formula:

$$TV = (L \times W \times W)/2; \text{ where } L = \text{Length (mm)}; W = \text{Width (mm)}.$$

Mean, Standard Deviation (SD) or Standard Error of Mean (SEM) were calculated for individual groups. Antitumor activity was evaluated as maximum tumor volume inhibition versus the control IgG1 arm (Arm 1). Data evaluation was performed using statistical software Graph Pad Prism V 5.0. Tumor growth inhibition (TGI) was calculated using the following formula:

$$TGI = (1 - T/C) \times 100\%$$

where, T=(Mean Tumor volume (TV) of the test arm on Day X−Mean TV of the test arm on Day 0; C=(Mean TV of the control Human IgG (Arm 1) on Day X−Mean TV of the control Human IgG (Arm 1) on Day 0.

The relative tumor volume (RTV) and tumor growth inhibition were calculated. Mean±SEM was calculated for the RTV data and tumor growth inhibition was presented as a percentage. Two way ANOVA was utilized for statistical analysis and p value <0.05 between arms was considered significant. The results show significant tumor growth reduction with both monotherapy with anti-CLEC2D antibody and in combination with check point monoclonal antibody against PDL1.

Significant tumor growth inhibition was observed in Arm 2, Arm 3, Arm 4 and Arm 5 compared to Arm 1, representing Control human IgG1. It was unexpected that significant tumor growth inhibition over entire study period was observed in animals treated with anti-CLEC2D monoclonal antibody clones, and anti-PDL1 antibody. More interestingly, a completely novel finding where tumor sizes were reduced by half in animals treated with a combination of anti-CLEC2D monoclonal antibody clone and anti-PDL1 monoclonal antibody was observed. This observation is very significant as the combination treatment with anti-CLEC2D antibody and anti-PDL1 antibody achieved this high level of tumor growth inhibition at a reduced dosage of 5 mg/kg. The data indicates significant anti tumor activity when anti-CLEC2D antibody was used alone and when it was used in combination with anti PDL1 antibody, showing that the antibody clones against CLEC2D antigen have great therapeutic potential for various disease indications.

During the study period, monoclonal antibody dosages were well tolerated with mild body weight loss. Based on cage side observations there was no visible signs of abnormal behaviour or any adverse clinical symptoms in any of the groups during the experimental period. T cell infiltration to the tumor site was analysed using immunohistochemistry (IHC) of the excised tumor. The harvested tumor cells were subjected to different types of T cell markers to understand the infiltration. Histology processing was conducted for immunohistochemistry for FFPE tissue (Formalin-Fixed Paraffin-Embedded (FFPE) tissue specimens). Animals were euthanized and the tumors were harvested & fixed in 10% neutral buffer formalin for 24 hours. The tissues were subjected to tissue processing. Paraffin embedded tissue blocks were prepared after completion of tissue processing. Subsequently, sectioning blade holder angle was adjusted to the surface of tissue block in the microtome. Coarse trimming was carried out, and fine sections of 5 micron thickness were taken and transferred to the tissue water bath. Formalin-Fixed Paraffin-Embedded (FFPE) tissue specimens were processed for IHC staining with standard reagents.

Samples were washed in washing buffer (PBST-0.3% tritonX-100) for 10 min. Samples were incubated with blocking solution (10% Normal goat serum and 3% BSA in PBS) for 30-60 minutes in humidified environment. Primary antibodies were diluted in antibody dilution buffer (3% BSA in PBS). The tissues were incubated with primary antibody against CD3 antigen at 1:100 dilution and incubated overnight at 4° C. Subsequently slides were washed three times in washing buffer for 10-30 minutes/wash. This was followed by incubation with secondary antibody Goat Anti-Rabbit IgG H&L (HRP) at room temperature. Slides were washed three times in washing buffer for 15-30 minutes for each wash. The DAB Chromogen was applied to develop proper intensity of tissue staining. Counterstaining was carried out with hematoxylin.

The tumor samples were immunohistochemically stained with anti-CD3 antibody. CD3 cell (Pan T cell marker) infiltration was observed in the periphery of tumor tissues in human IgG control (Arm 1). However, in animals treated with anti-CLEC2D antibody, check point antibody alone, or a combination of anti-CLEC2D antibody with a check point antibody, the CD3 cell infiltration was observed heterogeneously in periphery and also around the tumor cells. CD3, a membranous immunohistochemical marker, revealed mild to moderate degree of staining of tumor samples harvested from animals treated with anti-CLEC2D antibody, check point antibody, and a combination of anti-CLEC2D antibody with check point antibody. The data provides clear insights into the mechanisms of tumor mediated immune suppression Localization of Labelled Anti-CLEC2D Antibody In a separate imaging experiment, anti-CLEC2D antibody labelled with Alexa 647 was administered at a single dose of 10 mg/kg intravenously. The fluorescently labelled antibody was administered to huNOG-EXL mice bearing subcutaneous PC-3 tumor (Mean Tumor volume ~213 mm³). In-vivo imaging was carried out at 0 min, 5 min, 15 min, 30 min, 1 hr, 3 hr, 6 hr, 12 hr, 24 hr, 48 hr, 72 hr and 96 hr post administration of Alexa 647 labelled antibody (FIG. 20C). The monoclonal antibody against anti-CLEC2D antibody exhibited affinity (which was evident from tumor signal intensity) towards the target antigen of interest in huNOG-EXL mice bearing subcutaneous PC-3 tumor.

The signal intensity from the tumor appeared as early as 5 minutes post injection of the antibody and gradually increased with time. The peak signal intensity was observed at 3 hrs and the signal intensity from the tumor lasted until 96 hrs.

In Vivo Mouse Efficacy with Selected Monoclonal Antibody Products

In a separate follow up xenograft mouse study, the monoclonal antibody drug products were tested to evaluate tumor growth reduction upon monoclonal antibody treatment.

Origin of the animals: hGM-CSF/hIL3 NOG mice engrafted with human CD34+ hematopoietic stem cells (HSCs) stably develop extensive cell lineages as early as 6 to 8 weeks post-injection. Both myeloid and lymphoid lineage cells are present in peripheral blood, bone marrow, thymus and spleen and non-lymphoid tissue including lung and liver. For the current study huNOG-EXL mice with greater than 25% hCD45+ in peripheral blood were used Rationale: The procedure relies on super immunodeficient the hGM-CSF/hIL3 transgenic-NOG mice which upon engraftment with human hematopoietic stem cells, results in a human-like immune system (lymphoid & myeloid lineage of human origin). This model enables to study the key innate mechanisms involved in the efficacy of immuno-therapy related agents and provide a suitable model for establishment of human xenografts.

| Strain | huNOG-EXL |
|---|---|
| Sex | Male |
| Source | Taconic (USA) |
| Age at the start of experiment | 13-14 weeks |
| Body Weight of animals | 18-22 g |

Animal Care

Animal Welfare

Animals were taken care as per the regulations of Committee for the Purpose of Control and Supervision of Experiments on Animals (CPCSEA), Government of India and Association for Assessment and Accreditation of Laboratory Animal Care (AAALAC) guidelines.

Housing and Feeding

Animals were housed in individually ventilated cages maintained in a controlled environment with 22+3° C. temperature, 50+20% humidity, 12 h light/dark cycle and 15-20 fresh air changes per hour. Animals were housed group-wise and autoclaved corncob (Sparconn Life Sciences, Bangalore, India) was used as a bedding material. The animals were fed (NIH-31), ad libitum, with certified irradiated laboratory rodent diet during the study period.

Drinking Water

Fresh, potable water, filtered through RO, was provided ad libitum after autoclaving to all animals via bottle fitted with nozzle.

Preparation of Animals

The animals were kept under acclimatization in the experimental room for a period of 10 days. A thorough observation was performed before selecting the animals and only animals that were apparently healthy were used for the study.

Animal Identification

Animals were individually numbered and the cage cards indicating the experiment, study number, date of randomization, mouse strain, gender and individual mouse numbers were displayed to corresponding cages. After randomization group identity, treatment code, dosage, schedule and route of administration were included in the cage cards.

Experimental Procedure

Preparation of Tumor Cells

All procedures were performed in a laminar flow hood following sterile techniques. PC-3 (Human prostate adenocarcinoma) cells with a viability of >90% was chosen for the study. Around 5×106 cells were re-suspended in 200 µL of serum free media containing 50% of matrigel kept in ice.

Subcutaneous Injection of Cells

Male huNOG-EXL mice housed in Individually Ventilated Cages (IVCs) were used for the study. PC-3 cell line was propagated into the animals by injecting the cells subcutaneously in the right flank region of the animals. The implanted area was monitored for growth of tumor. Four days post injection of cells animals were randomized based on tumor volume (Mean tumor volume≈37 mm3) and dosing was initiated.

Route and Mode of Administration of the Test Substance:

Required quantity of test antibodies were prepared and stored at 2-80 C. The antibodies were administered intraperitoneally. The dose of individual animal was adjusted based on the body weight. For each antibody, unused new syringes and needles were used.

Experimental Design

Monoclonal antibody products were used at 10 mg/kg dosage
  a. C5511 mAb group;
  b. C6481 mAb group.

Vehicle control IgG1 group—Control IgG1 was used at 10 mg/kg dosage.

5 animals per treatment group.

Antibody drug product was injected every 3 days for first 2 weeks and once weekly for remaining study period.

Total study duration 36 days.

Tumor volume measurement and animal body weight measurement was carried out every 3 days.

Dose and Route of Administration

Required quantity of test compounds (ready to use formulation) were used and it was stored at −200 C. Test compounds were administered intraperitoneally to their respective groups. The dose of each individual animal was adjusted based on the body weight determined just before dosing and dose volume was maintained at 10 mL/kg body weight. For each test compound, sterile new syringes and needles were used. The test compounds were freshly thawed on the day of drug administration.

Observations

Body weight—Individual body weight was measured once every three days during the study period. The % change in body weight of individual mouse was calculated and recorded.

Clinical sign—Animals were observed for visible clinical signs and recorded once in every third day during the treatment period.

Tumor volume measurement—The tumor volume was determined by two-dimensional measurement with a digital Vernier calliper on the day of randomization (Day 1). Second tumor volume measurement was on day 3, further every third day till the end of the experiment the tumor volume measurement was carried out (i.e. on the same days when body weight was taken). Using a Vernier calliper the length (L) and width (W) of the tumor was measured. Tumor volume (TV) was calculated using the following formula:

$$\text{Tumor volume (mm3)} = \frac{L \times W2}{2}$$

Where, L=Length (mm); W=Width (mm).

Mean, Standard Deviation (SD) or Standard Error of Mean (SEM) were calculated for individual groups.

Antitumor Activity

Antitumor activity was evaluated as maximum tumor volume inhibition versus the vehicle control group. Data evaluation was performed using statistical software Graph Pad Prism V 5.0.

Tumor growth inhibition (TGI)

TGI was calculated using the following formula:

$$\text{TGI} = (1 - T/C) \times 100$$

Where, T=(Mean TV of the test group on Day X−Mean TV of the test group on Day 1) C=(Mean TV of the control group on Day X−Mean TV of the control group on Day 1)

Relative tumor volume (RTV)

Relative Tumor volume (RTV) was calculated using the following formula:

$$RTV = \frac{Tx \text{ (absolute tumor volume of the respective tumor on day } x)}{T1 \text{ (absolute tumor volume of same tumor on day 1)}}$$

Statistical Analysis

For the evaluation of the statistical significance of tumor inhibition, Two-way ANOVA followed by Bonferroni post hoc test was performed using Graph Pad Prism V 8.3.0. p values <0.05 indicate statistically significant differences between groups.

Necropsy

Tumor burden (TV>1500 mm3) and tumor necrosis/ulceration were observed due to progressive tumor growth. Hence, based on tumor end points & ethical reasons (Day 36), all animals in all experimental groups were humanely euthanized & gross pathological observations were recorded. Prior to euthanasia, blood sampling was carried out, serum was separated and stored at −80° C. All live animals & excised tumor tissues were photographed with scale and whole tumor tissues were formalin-fixed.

Results Obtained from the In Vivo Studies

Antitumor Activity

In this study, huNOG-EXL mice bearing PC-3 tumors were treated with test compounds at a dose of 10 mg/kg intraperitoneally (On day 1, 3, 6, 9, 12, 18, 24, 30 & 33). Under the present experimental condition, the vehicle control IgG1 group showed progressive tumor growth during the experimental period. Hence, other treatment groups were compared with this group for anticancer efficacy evaluation. Among the tested dose and regimen, two test arms revealed C5511 mAb group and C6481 mAb group showed significant tumor growth inhibition as p<0.001 and p<0.05 respectively when compared to vehicle control IgG1 on day 24. Whereas, on day 36 only C5511 mAb group exhibited significant tumor growth inhibition as p<0.05 when compared to vehicle control IgG1 group. The data is presented in Table 43.

TABLE 43

Effect of test compounds in humanized (huNOG-EXL) mice bearing subcutaneous PC-3 tumor xenografts

| Test Compound | Number of animals/ group | % TGI (Day 24) | Statistical Significance (Day 24) | % TGI (Day 36) | Statistical Significance (Day 36) | Mean % BWC (Day 36) |
|---|---|---|---|---|---|---|
| C5511 mAb group (10 mg/kg, i.p; On day 1, 3, 6, 9, 12, 18, 24, 30 & 33) | 5 | 49 | ***(p < 0.001) | 35 | *(p < 0.05) | −14 |
| Vehicle Control IgG1 group | 5 | — | — | — | — | −21 |

TABLE 43-continued

Effect of test compounds in humanized (huNOG-EXL) mice bearing subcutaneous PC-3 tumor xenografts

| Test Compound | Number of animals/ group | % TGI (Day 24) | Statistical Significance (Day 24) | % TGI (Day 36) | Statistical Significance (Day 36) | Mean % BWC (Day 36) |
|---|---|---|---|---|---|---|
| (10 mg/kg, i.p; On day 1, 3, 6, 9, 12, 18, 24, 30 & 33) | | | | | | |
| C6481 mAb group (10 mg/kg, i.p; On day 1, 3, 6, 9, 12, 18, 24, 30 & 33) | 5 | 25 | *(p < 0.05) | 8 | ns | −15 |

TGI—Tumor growth inhibition (TGI was calculated against vehicle control IgG1 group)
BWC—Body weight change
***$p < 0.001$, *$p < 0.05$ statistically significant when respective treatment groups were compared to vehicle control IgG1 group.
ns Statistically non-significant when respective treatment groups were compared to vehicle control IgG1 group.

Tumor Volume (TV) & Delta Tumor Volume (ΔTV) on Day 24 and Day 36

On day 24, the mean Tumor volume (mm3) for C5511 mAb group, Vehicle control IgG1 group, & C6481 mAb group were 241±31, 474±38, and 355±68, respectively. Further the mean delta tumor volume (ΔTV) on day 24 for C5511 mAb group, vehicle control IgG1 group, & C6481 mAb groups were 204±32, 437±38, and 318±68 mm3, respectively. The treatment groups, C5511 mAb group and C6481 mAb group showed significant decrease (p<0.001 & p<0.05) in the tumor volume and delta tumor volume when compared to Vehicle control IgG1 group on day 24. The mean tumor volume on day 36 for C5511 mAb group, vehicle control IgG1 group, and C6481 mAb group were 690±186, 1062±157, and 977±230 mm3 respectively. The mean delta tumor volume (ΔTV) on day 36 for C5511 mAb group, vehicle control IgG1 group, and C6481 mAb groups were 654±187, 1025±159, and 940±231 mm3 respectively. The treatment groups, C5511 mAb group showed significant decrease (p<0.05) in the tumor volume and delta tumor volume when compared to vehicle control IgG1 group. The results of tumor volume (TV) & Delta tumor volume (ΔTV) for all treatment groups are summarized in table 44 and 45, and FIGS. 20D, 20E, 20F and 20G.

TABLE 44

Effect of test compounds on mean tumor volume of (huNOG-EXL) mice bearing subcutaneous PC-3 tumor xenograft

| | | Mean Tumor volume (mm$^3$) | | | | | | | | | | | | |
|---|---|---|---|---|---|---|---|---|---|---|---|---|---|---|
| | | Days | | | | | | | | | | | | |
| Groups | | 1 | 3 | 6 | 9 | 12 | 15 | 18 | 21 | 24 | 27 | 30 | 33 | 36 |
| C5511 mAb group (10 mg/kg, i.p; On day 1, 3, 6, 9, 12, 18, 24, 30 & 33) | Mean | 37 | 58 | 78 | 97 | 112 | 152 | 179 | 213 | 241 | 356 | 508 | 621 | 690 |
| | S.E.M | 1 | 3 | 4 | 6 | 2 | 12 | 39 | 31 | 31 | 60 | 95 | 143 | 186 |
| Vehicle control IgG1 group (10 mg/kg, i.p; On day 1, 3, 6, 9, 12, 18, 24, 30 & 33) | Mean | 37 | 61 | 94 | 114 | 131 | 190 | 270 | 363 | 474 | 569 | 727 | 894 | 1062 |
| | S.E.M | 1 | 2 | 4 | 7 | 11 | 12 | 25 | 32 | 38 | 38 | 69 | 83 | 157 |
| C6481 mAb group (10 mg/kg, i.p; On day 1, 3, 6, 9, 12, 18, 24, 30 & 33) | Mean | 39 | 54 | 79 | 101 | 121 | 166 | 207 | 288 | 355 | 456 | 587 | 734 | 977 |
| | S.E.M | 2 | 2 | 6 | 11 | 15 | 21 | 33 | 60 | 68 | 102 | 108 | 125 | 230 |

TABLE 45

Effect of test compounds on Δ (Delta) mean tumor volume of (huNOG-EXL) mice bearing subcutaneous PC-3 tumor xenograft

| Groups | | Δ (Delta) Mean Tumor Volume (mm$^3$) Days | | | | | | | | | | | |
|---|---|---|---|---|---|---|---|---|---|---|---|---|---|
| | | 1 | 3 | 6 | 9 | 12 | 15 | 18 | 21 | 24 | 27 | 30 | 33 | 36 |
| C5511 mAb group (10 mg/kg, i.p; On day 1, 3, 6, 9, 12, 18, 24, 30 & 33) | Mean | 0 | 20 | 41 | 60 | 75 | 115 | 142 | 176 | 204 | 320 | 473 | 585 | 654 |
| | S.E.M | 0 | 3 | 4 | 5 | 2 | 12 | 39 | 32 | 32 | 61 | 97 | 145 | 187 |
| Vehicle control IgG1 group (10 mg/kg, i.p; On day 1, 3, 6, 9, 12, 18, 24, 30 & 33) | Mean | 0 | 24 | 56 | 77 | 94 | 153 | 233 | 326 | 437 | 531 | 689 | 856 | 1025 |
| | S.E.M | 0 | 2 | 4 | 7 | 11 | 13 | 25 | 33 | 38 | 39 | 70 | 83 | 159 |
| C6481 mAb group (10 mg/kg, i.p; On day 1, 3, 6, 9, 12, 18, 24, 30 & 33) | Mean | 0 | 15 | 42 | 64 | 83 | 129 | 170 | 250 | 318 | 419 | 550 | 697 | 940 |
| | S.E.M | 0 | 1 | 5 | 11 | 15 | 21 | 33 | 60 | 68 | 102 | 108 | 125 | 231 |

Percentage Tumor Growth Inhibition (% TGI) on Day 24 and Day 36

The % Tumor Growth Inhibition (% TGI) for C5511 mAb group showed maximum value of 49% followed by C6481 mAb group with % TGI value of 25%, on day 24. Whereas, the % TGI on day 36, values for C5511 mAb group, and C6481 mAb groups were 35%, and 8% respectively on day 36 against Vehicle control IgG1 group. The individual animal Tumor Growth Inhibition are summarized in Table 46.

TABLE 46

% Tumor growth inhibition (% TGI) of test compounds against (huNOG-EXL) mice bearing PC-3 tumor xenograft

| Groups | % Tumor growth inhibition (% TGI) by Delta | | | | | | | | | | | | |
|---|---|---|---|---|---|---|---|---|---|---|---|---|---|
| | Day 1 | Day 3 | Day 6 | Day 9 | Day 12 | Day 15 | Day 18 | Day 21 | Day 24 | Day 27 | Day 30 | Day 33 | Day 36 |
| C5511 mAb group (10 mg/kg, i.p; On day 1, 3, 6, 9, 12, 18, 24, 30 & 33) | 0 | 6 | 17 | 15 | 14 | 20 | 34 | 41 | 49 | 37 | 30 | 31 | 35 |
| Vehicle Control IgG1 group P3E (10 mg/kg, i.p; On day 1, 3, 6, 9, 12, 18, 24, 30 & 33) | −1 | 3 | 6 | 9 | 12 | 17 | 25 | 5 | 15 | 16 | 9 | 8 | 2 |
| C6481 mAb group (10 mg/kg, i.p; On day 1, 3, 6, 9, 12, 18, 24, 30 & 33) | −4 | 12 | 16 | 11 | 8 | 13 | 24 | 21 | 25 | 20 | 19 | 18 | 8 |

Relative Tumor Volume (RTV) & Delta Relative Tumor Volume (ΔRTV) on Day 24 and Day 36

Figure 20H:
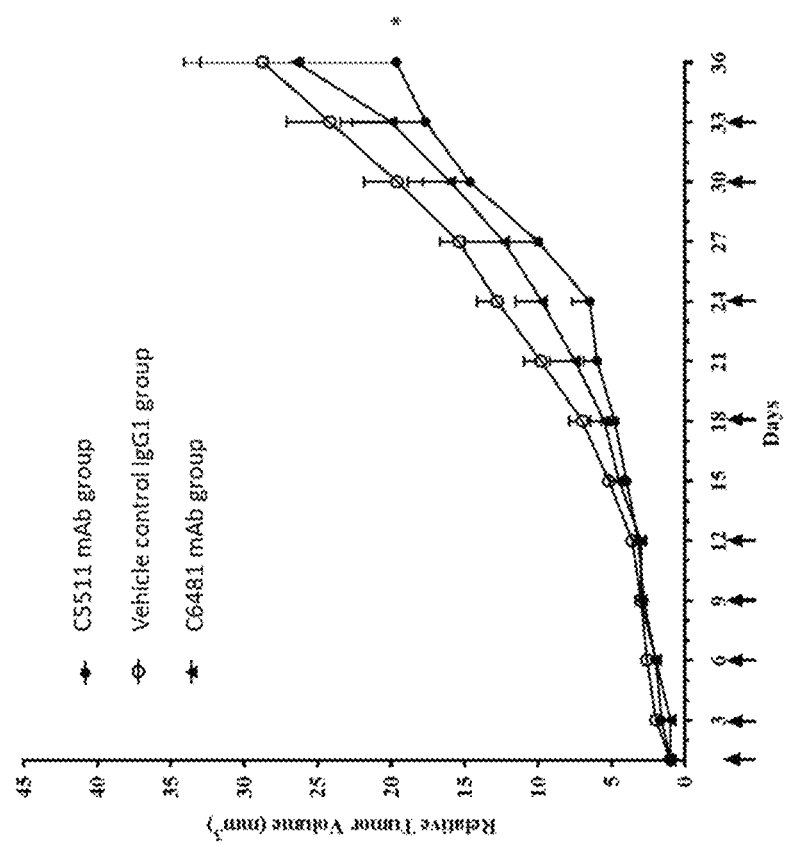
Figure 20I:
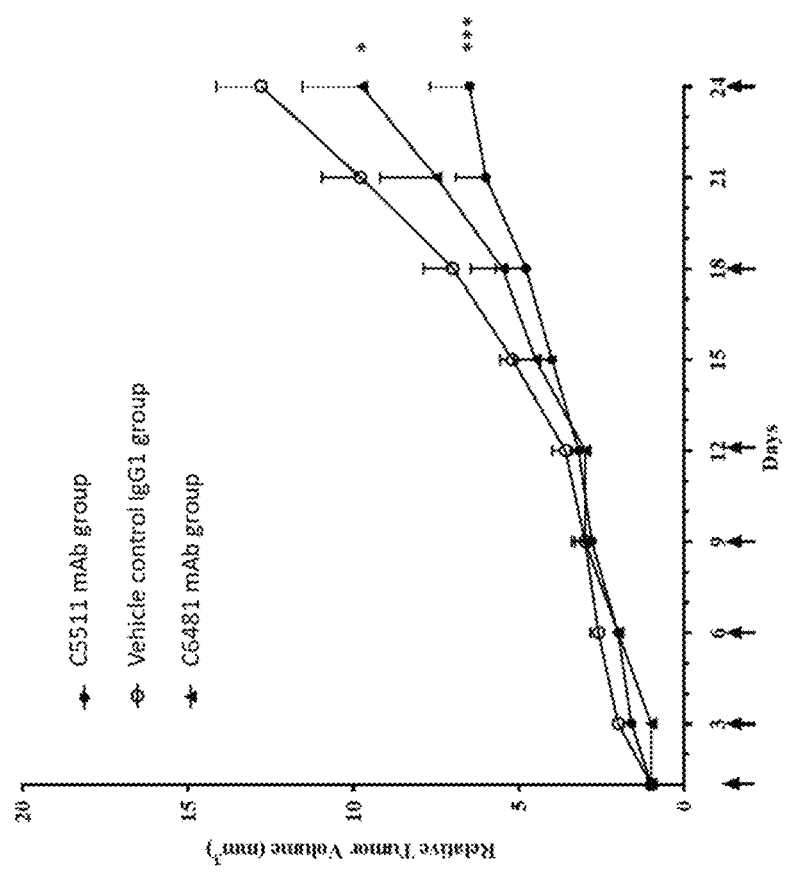
Figure 20J:
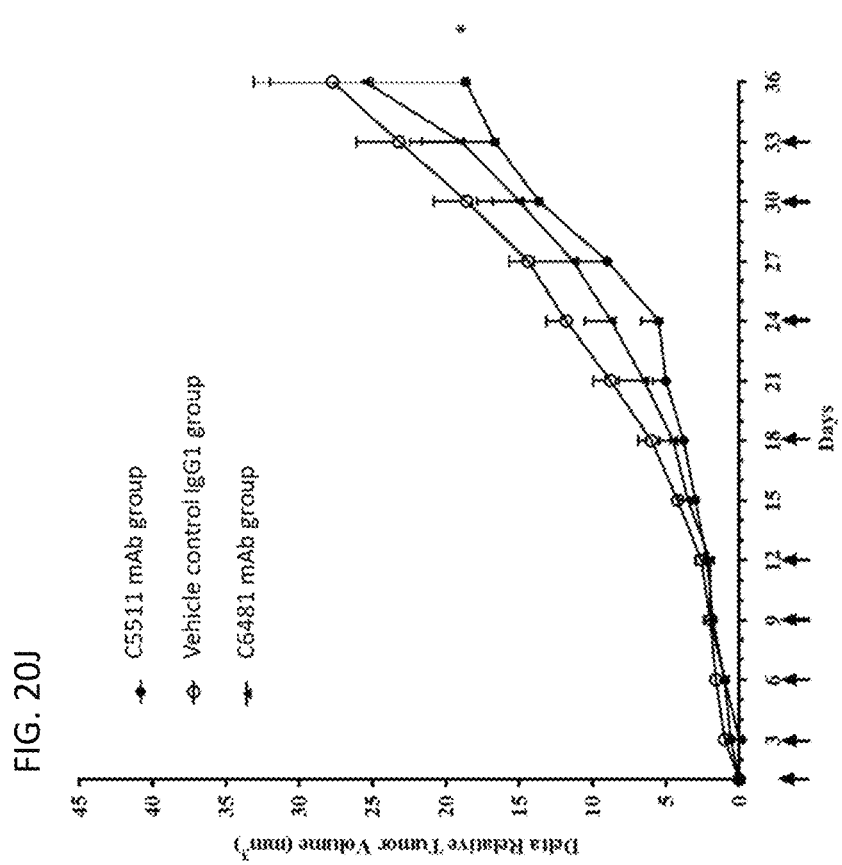
Figure 20K:
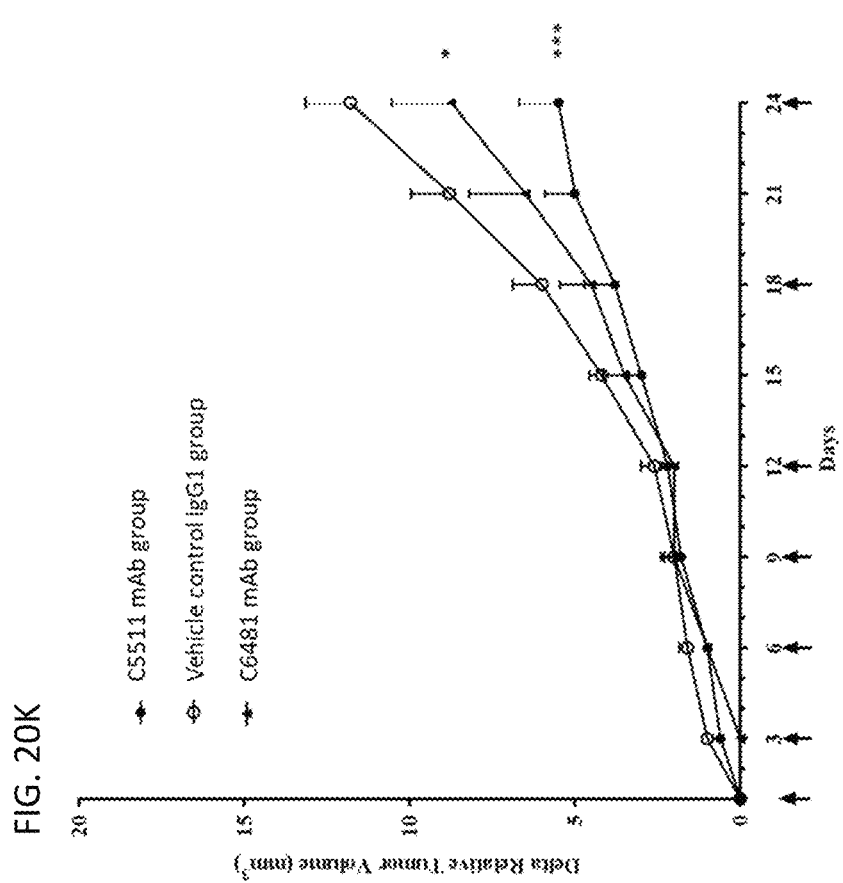

On day 24, the mean relative tumor volume for C5511 mAb group vehicle control IgG1 group, and C6481 mAb group were 7±1, 13±1, and 10±2 respectively. The delta relative tumor volume (ΔRTV) for C5511 mAb group, vehicle control IgG1 group, and C6481 mAb group were 6±1, 12±1, and 9±2 respectively as shown in table 5. The treatment groups, C5511 mAb group showed significant decrease (p<0.001) in the relative tumor volume and delta relative tumor volume when compared to vehicle control IgG1 group FIGS. 20H and 20I. The mean relative tumor volume on day 36, 20±6 in C5511 mAb group, 29±5 in vehicle control IgG1 group, and 27±7 in C6481 mAb group. Whereas on day 36, the mean delta tumor volume (ΔRTV) for C5511 mAb group, vehicle control IgG1 group and C6481 mAb groups were 19±6, 28±5, and 26±7 respectively as shown in Table 47 and FIGS. 20J and 20K.

TABLE 47

Relative tumor volume (RTV) of test compounds against (huNOG-EXL) mice bearing PC-3 tumor xenograft Relative Tumor Volume (mm³)

| Groups | | Day 1 | Day 3 | Day 6 | Day 9 | Day 12 | Day 15 | Day 18 | Day 21 | Day 24 | Day 27 | Day 30 | Day 33 | Day 36 |
|---|---|---|---|---|---|---|---|---|---|---|---|---|---|---|
| C5511 mAb group (10 mg/kg, i.p; On day 1, 3, 6, 9, 12, 18, 24, 30 & 33) | Mean | 1 | 2 | 2 | 3 | 3 | 4 | 5 | 6 | 7 | 10 | 15 | 18 | 20 |
| | S.E.M | 0 | 0 | 0 | 0 | 0 | 0 | 1 | 1 | 1 | 2 | 3 | 5 | 6 |
| Vehicle control IgG1 group (10 mg/kg, i.p; On day 1, 3, 6, 9, 12, 18, 24, 30 & 33) | Mean | 1 | 2 | 3 | 3 | 4 | 5 | 7 | 10 | 13 | 15 | 20 | 24 | 29 |
| | S.E.M | 0 | 0 | 0 | 0 | 0 | 0 | 1 | 1 | 1 | 1 | 2 | 3 | 5 |
| C6481 mAb group (10 mg/kg, i.p; On day 1, 3, 6, 9, 12, 18, 24, 30 & 33) | Mean | 1 | 1 | 2 | 3 | 3 | 4 | 6 | 8 | 10 | 12 | 16 | 20 | 27 |
| | S.E.M | 0 | 0 | 0 | 0 | 0 | 1 | 1 | 2 | 2 | 3 | 3 | 4 | 7 |

TABLE 48

Delta relative tumor volume (ΔRTV) of test compounds against (huNOG-EXL) mice bearing PC-3 tumor xenograft Delta Relative Tumor Volume (mm³)

| Groups | | Day 1 | Day 3 | Day 6 | Day 9 | Day 12 | Day 15 | Day 18 | Day 21 | Day 24 | Day 27 | Day 30 | Day 33 | Day 36 |
|---|---|---|---|---|---|---|---|---|---|---|---|---|---|---|
| C5511 mAb group (10 mg/kg, i.p; On day 1, 3, 6, 9, 12, 18, 24, 30 & 33) | Mean | 0 | 1 | 1 | 2 | 2 | 3 | 4 | 5 | 6 | 9 | 14 | 17 | 19 |
| | S.E.M | 0 | 0 | 0 | 0 | 0 | 0 | 1 | 1 | 1 | 2 | 3 | 5 | 6 |
| Vehicle control IgG1 group (10 mg/kg, i.p; On day 1, 3, 6, 9, 12, 18, 24, 30 & 33) | Mean | 0 | 1 | 2 | 2 | 3 | 4 | 6 | 9 | 12 | 14 | 19 | 23 | 28 |
| | S.E.M | 0 | 0 | 0 | 0 | 0 | 0 | 1 | 1 | 1 | 1 | 2 | 3 | 5 |
| C6481 mAb group (10 mg/kg, i.p; On day 1, 3, 6, 9, 12, 18, 24, 30 & 33) | Mean | 0 | 0 | 1 | 2 | 2 | 3 | 5 | 7 | 9 | 11 | 15 | 19 | 26 |
| | S.E.M | 0 | 0 | 0 | 0 | 0 | 1 | 1 | 2 | 2 | 3 | 3 | 4 | 7 |

The study revealed, under the test conditions, test compounds used in C5511 mAb group, vehicle control IgG1 group and C6481 mAb group at a dose of 10 mg/kg intraperitoneally (on day 1, 3, 6, 9, 12, 18, 24, 30 & 33) were tested to evaluate the anticancer efficacy against PC-3 tumor xenograft in huNOG-EXL mice. Efficacy evaluation was calculated against vehicle control IgG1 group. Among tested compounds, C5511 mAb group and C6481 mAb group exhibited significant anti-cancer efficacy when compared with vehicle control IgG1 group. Based on statistical analysis of tumor volume, tumor growth inhibition, relative tumor volume, treatment with C5511 mAb group showed better antitumor efficacy compared to test compound used in C6481 mAb group. Moderate body weight loss observed in all the treatment groups.

In this context, it should be noted that the monoclonal antibody products tested in current HuNOG study, were utilized under sub optimal assay condition. The monoclonal antibody products used in this study require human NK cells for optimal function and till date no animal model is available where human NK cells could mimic the in vivo condition. Considering these constrains, HuNOG model was used rationally, wherein the human immune cells (including human NK cells) are established in mouse. However, the abundance of NK cells are significantly low. Therefore HuNOG mice model is justifiably provides a suitable experimental condition to test these novel Anti-CLEC2D monoclonal antibody products. Moreover, it was observed that the overall number of human immune cells start to decline, as the animals become older, with progression of the study. These levels of tumor growth reduction in the HuNOG PC3 xenograft model is surprising, indicating highly superior efficacy of the novel Anti-CLEC2D monoclonal antibodies of the present disclosure.

Example 8: Characterization of Anti-CLEC2D Monoclonal Antibody

Purified anti-CLEC2D antibody was subjected various biophysical and biochemical characterization indicative of multiple inherent properties of antibody such as, mass, conformation, posttranslational modification, amongst others.

In order to identify the confirmation of isolated fragments, SDS PAGE was carried out

TABLE 49 intact mass analysis

Figure 21A:
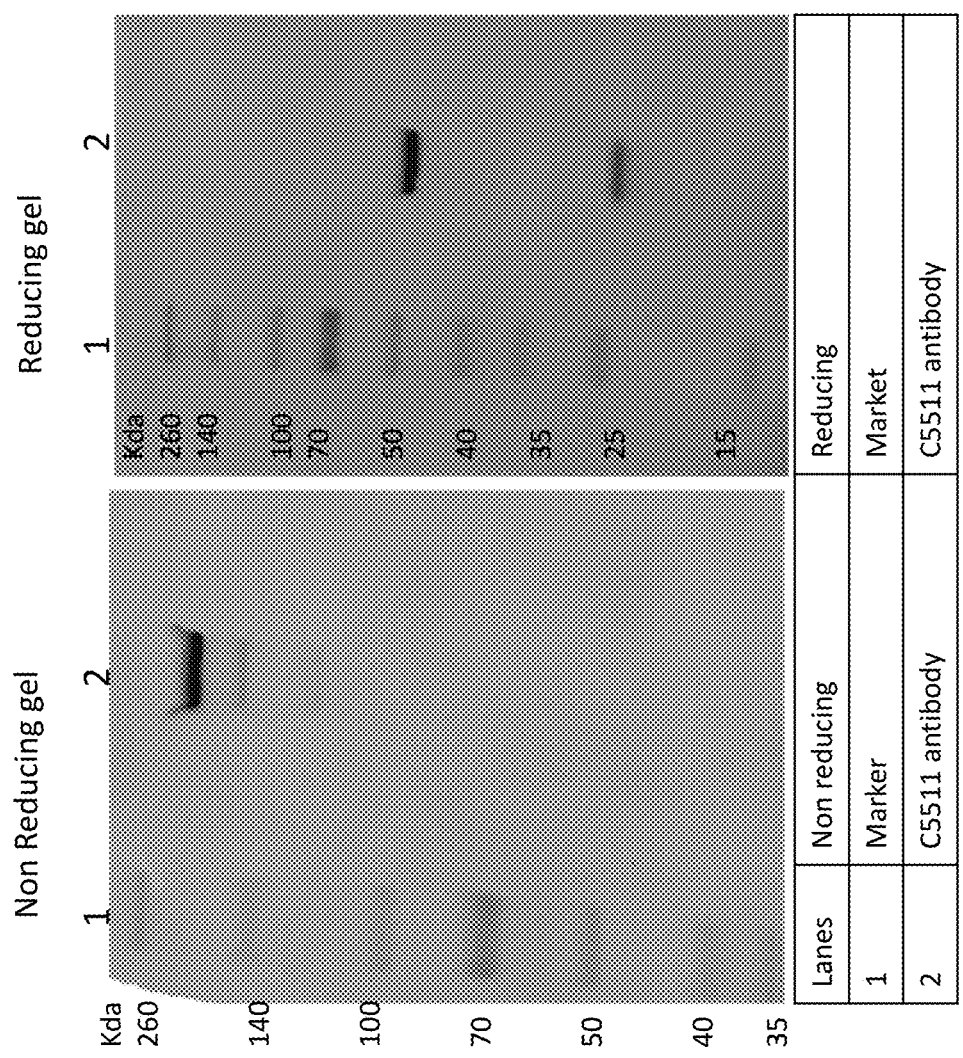

| Sr. No. | Mass (Da) | Intensity (Counts) | Intensity (%) |
|---|---|---|---|
| 1 | 149301 | 252629056 | 100 |
| 2 | 149131 | 228375856 | 90.4 |
| 3 | 149302 | 227410624 | 90.02 |
| 4 | 149132 | 222516864 | 88.08 |
| 5 | 149300 | 217502800 | 86.1 |
| 6 | 149466 | 200116976 | 79.21 |
| 7 | 149465 | 198714320 | 78.66 |
| 8 | 149130 | 186866464 | 73.97 |
| 9 | 149133 | 183556800 | 72.66 |
| 10 | 149303 | 170258512 | 67.39 | under non-reducing conditions, where a single major band corresponding to a molecular weight (MW) of 150 kDa was observed for all the samples indicating the intact anti-CLEC2D antibody. While under reducing conditions, two bands were evident at 25 kDa and 50 kDa which were associated with light chain and heavy chains of the anti-CLEC2D antibody. SDS PAGE data has been shown in FIG. 21A).

The intact mass experiment was carried out using methods based on ELISA, flow cytometry, Western blotting, BIACORE, Waters UPLC H-Class Bio with Xevo G2 XS QTOF with UNIFI. The Xevo G2 XS QTOF was run in positive sensitivity MS only mode. With no prior treatment, 1 μg sample was analyzed using the same chromatographic conditions (only gradient different from subunit mass analysis) and mass spectrometric conditions as subunit mass analysis as described above.

Figure 21B:
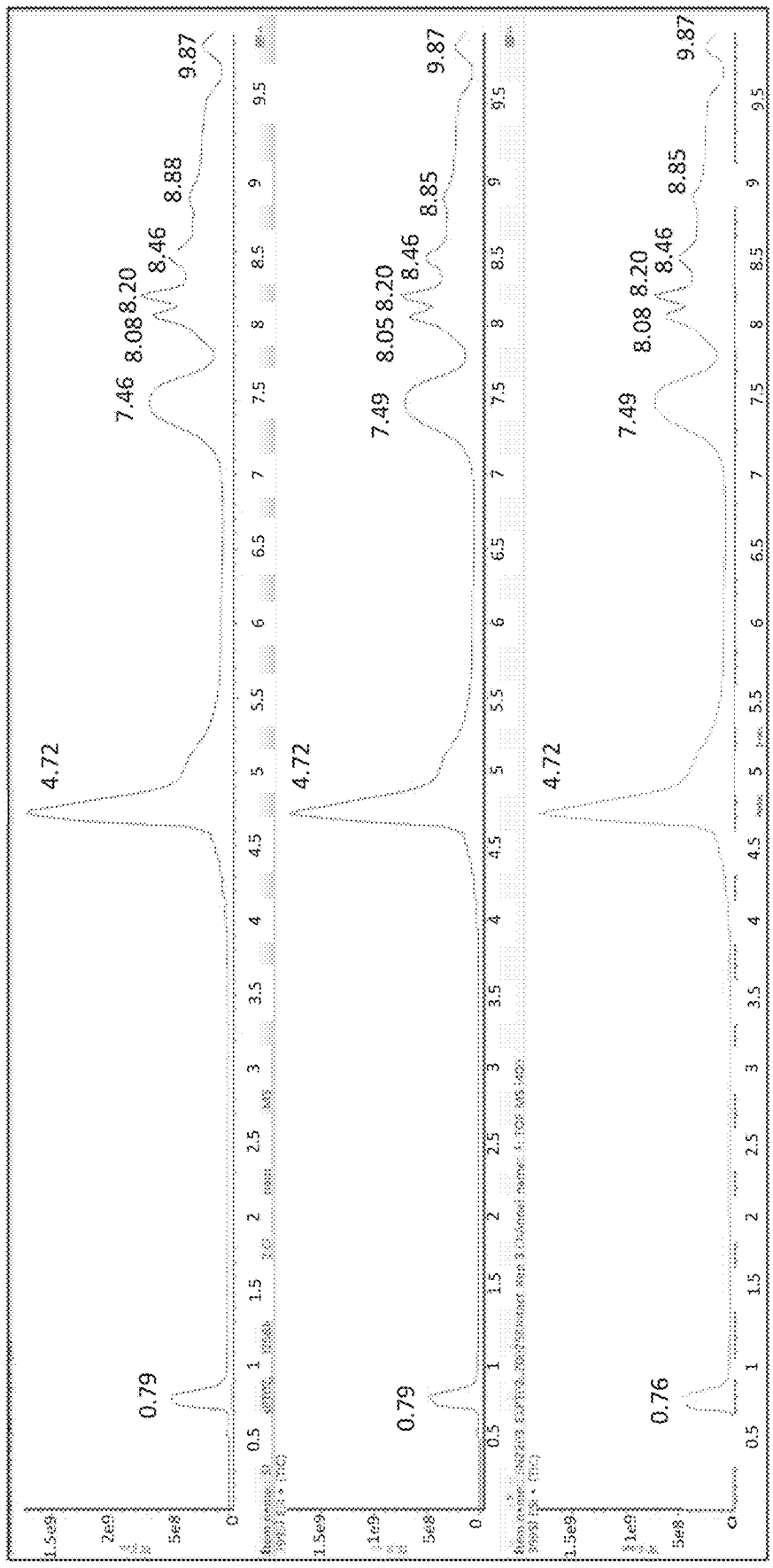

The most abundant masses are close to generic glycosylated IgG1 monoclonal antibody as shown in FIG. 21B), and Table 49, thus confirming the molecular weight of anti-CLEC2D monoclonal antibody.

Figure 21C:
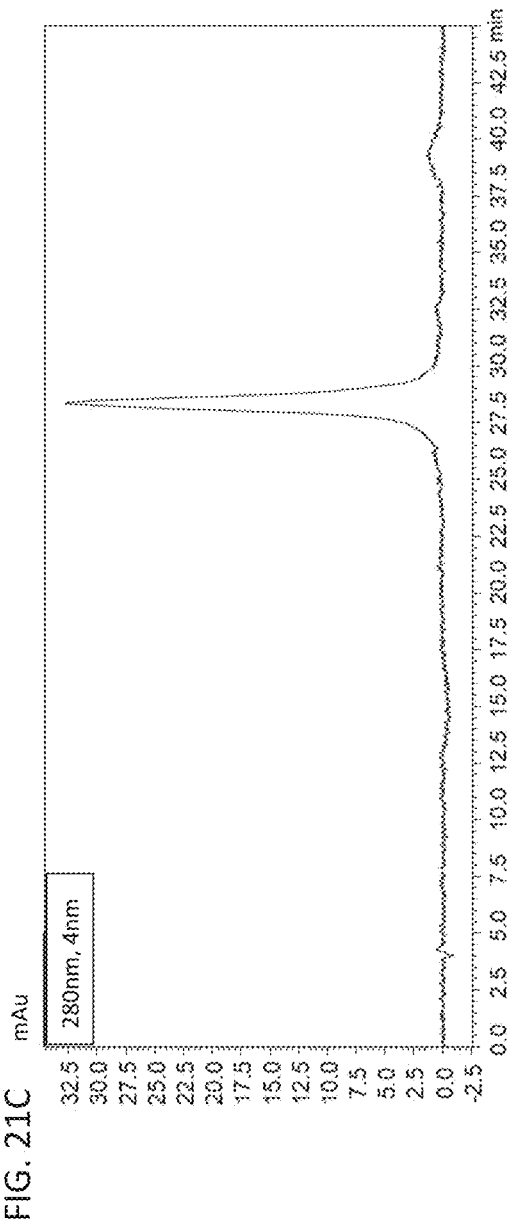

Acidic, Basic and Main peak was resolved and the percentage of each variant along with main peak is tabulated in below shows the charge distribution determined by WCX-LC method in anti-CLEC2D antibody molecule. The relative abundance of acidic isoforms is generally attributed to oxidation, deamidation, and glycation process within the antibody. On the other hand, the presence of C-terminal Lysine and amidation are mainly responsible for forming basic isoforms in the antibody. The WCX chromatogram is shown in FIG. 21C).
Acidic Species: 10%
Main Species: 83%
Basic Species: 7%

Figure 21D:
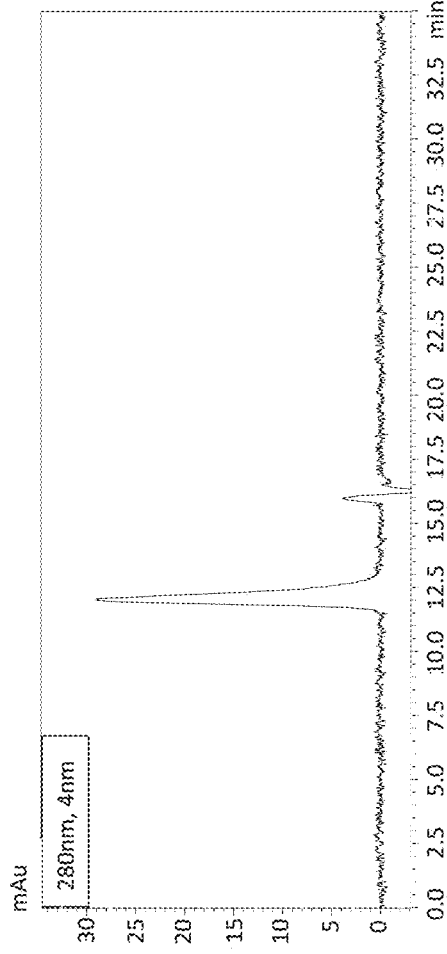
Figure 21E:
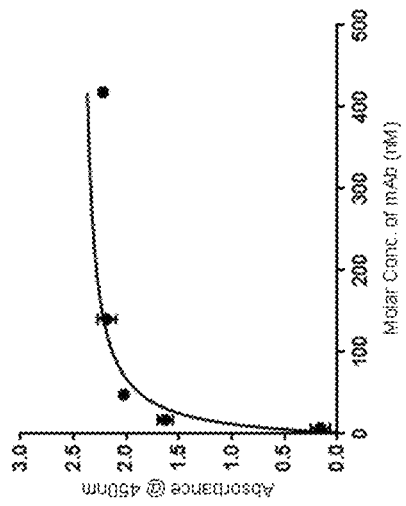

It is known that protein aggregation can induce immunogenicity; although a small amount of aggregates is expected, this amount is likely to increase due to stress conditions that a antibody may undergo during its manufacture, purification, formulation, and shelf-life. Aggregation can also induce production of anti-drug antibodies (ADAs) which can result in the loss of activity or cause adverse effects upon administration. Anti-CLEC2D antibody sample was analyzed by size exclusion chromatography (SEC) and typical chromatograms were shown in below. As observed in attached chromatogram in FIG. 21D), 100% monomer was observed thus confirming that sample is free from any aggregates and/or degradant.

One of the important quality attribute for therapeutic monoclonal antibodies is their glycosylation profile. To check the glycan distributions of anti-CLEC2D antibody, the sample was analyzed by HILIC N-glycan profiling method. The major glycan such as G0F, G1F, G1F' and G2F were identified and total percentage of Galactosylated glycan was found to be around 46.44%.

Binding Studies Against Soluble CLEC2D Antigen:

Binding studies were carried out using anti-CLEC2D antibody against purified soluble CLEC2D antigen while the measurements were made through both ELISA and SPR based methods.

Besides, SPR was also employed to understand the interaction between anti-CLEC2D antibody and FcRn, as Binding interactions with the neonatal Fc receptor (FcRn) are one determinant of pharmacokinetic properties of recombinant human monoclonal antibody therapeutics, and a conserved binding motif in the crystallizable fragment (Fc) region of IgG molecules interacts with FcRn.

ELISA:

Soluble CLEC2D antigen was produced and purified using CHO cell culture system and Anti-CLEC2D antibody C5511 were used for ELISA assay. The method was optimized using various ELISA formats, as exemplified by, direct ELISA, indirect ELISA and sandwich ELISA. Finally, the optimized ELISA assay was based on protein A coated plate wherein the antigen was labelled with biotin moiety. The Anti-CLEC2D antibody dilutions ranging from 0.01 μg/mL to 62.5 μg/mL were made in dilution buffer 0.5% BSA in (DPBS with 0.05% tween 20).

The protein A coated wells were washed thrice with 200 μL of wash buffer (DPBS with 0.1% Tween20). 100 μL of each antibody dilution was added to well, and the plate was incubated for 90 minutes at room temperature on orbital shaker. Each well was rinsed four times with 200 μL of wash buffer. 100 μL of different concentration of biotinylated antigen, labelling was carried out as described before, was added to each well and plate was incubated for 60 minutes at room temperature on orbital shaker. Each well was rinsed four times with 200 μL of wash buffer. 100 μL of 1:5000 diluted HRP-labelled streptavidin was added and plate was incubated for 60 minutes at room temperature on orbital shaker. Each well was rinsed five times with 200 μL of wash buffer. 100 μl 1×TMB was added and the plate was incubated for 30 min at RT in dark. After 30 minutes 100 μl of stop solution was added and the plate was read at 450 nm.

Figure 21F:
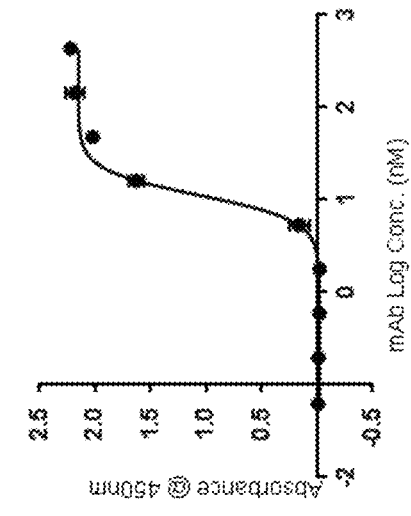

Further to appropriate subtraction of blank, absorbance values were plotted and fit into binding model based on sigmoidal association, using Graphpad PRISM 6.0. The KD value as obtained from the fit is found to be 10-17 nM for anti-CLEC2D antibody to purified CLEC2D antigen (FIG. 21F). The experiments were repeated at least 3 times independently in triplicates to achieve statistical confidence and variation was found to be less than 5%, while confidence interval resides within 95%.

BIAcore binding studies with anti-CLEC2D antibody against soluble CLEC2D antigen CLEC2D antigen interaction with specific monoclonal antibody was monitored through surface plasmon resonance, using BIACORE. The kinetic parameters for the interaction of anti-CLEC2D antibodies with CLEC2D antigen were evaluated. This method was used to screen potential high affinity monoclonal antibodies against CLEC2D antigen. Different monoclonal antibodies revealed differential affinities towards the CLEC2D antigen. The experiment revealed affinity constants ranging from less than 100 nM (e.g., ≤90 nM, ≤80 nM, ≤70 nM, ≤60 nM, ≤50 nM, ≤40 nM, ≤30 nM, ≤20 nM, ≤10 nM, ≤5 nM, or ≤1 nM).

Figure 21G:
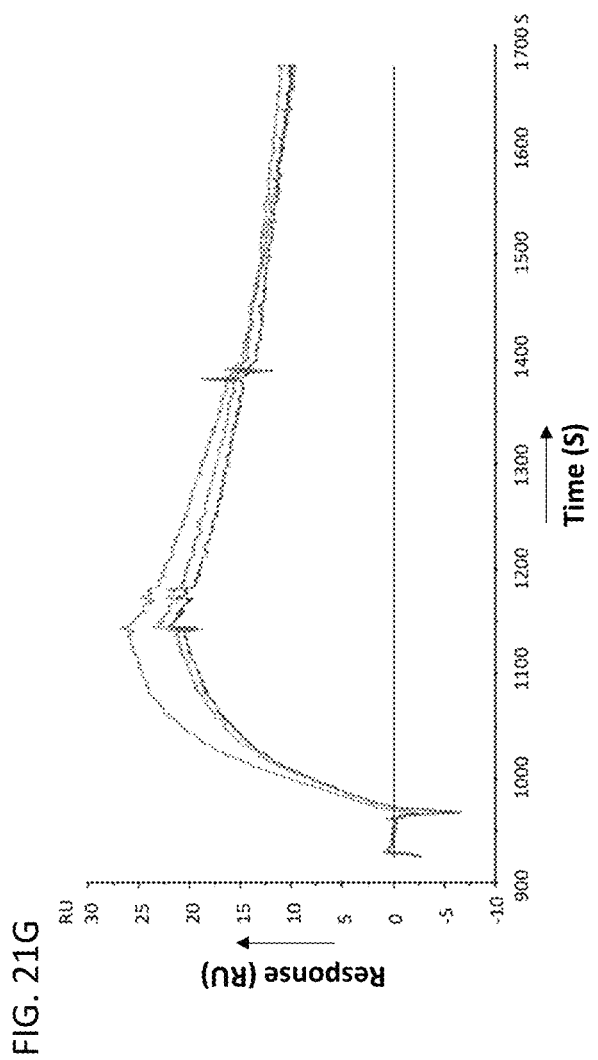

CLEC2D antigen binding kinetics and affinity studies between CLEC2D antigen and Anti-CLEC2D antibody binding studies were carried out using Anti-His Antibody binding capture chemistry on BIACORE 3000 instrument. His Capture Kit (GE healthcare) was immobilized onto CM5 chip surface at an RU of ~1800. CLEC2D antigen was captured on Anti-His, coupled with CM5 chip, surface, at a concentration of ~200 µg/mL, wherein the dilution of antigen was made through running buffer comprising HBS-EP+ buffer (GE healthcare). Subsequently anti-CLEC2D antibody C5511 was passed at concentrations ranging from 1 to 100 µg/mL, at association and dissociation time of 3 minutes and 25 minutes, respectively. Antibody dilutions were made in HBS-EP+ buffer (GE healthcare). Response curves (FIG. 21G) obtained were appropriately subtracted from reference flow cell signal and blanks, respectively and fit to a 1:1:1 Langmuir binding leading to estimated KD of ~$10^9$M−1.

FcRn Binding

Surface plasmon resonance (SPR) biosensor assays are often used to characterize interactions between FcRn and antibody therapeutics. Studies have shown that FcRn interacts with a binding motif in the crystallizable fragment (Fc) of IgG at the CH2-CH3 domain interface in a pH-dependent manner. 6.8 The pH dependency of this interaction is essential for maintaining the long serum half-life of IgG molecules. Specifically, in the endosomes of endothelial cells (~pH 6.0), IgG internalized through pinocytosis binds to FcRn to form IgG-FcRn complexes; the IgG-FcRn complexes are then trafficked to the cell surface where IgG is released back into the circulation at physiological pH (~7.4). This prevents lysosomal degradation of the IgG. For recombinant human monoclonal antibody (rhumAb) therapeutics, the FcRn-rhumAb binding interaction is a critical determinant of pharmacokinetic (PK) properties and targeted engineering of the FcRn binding motif may enable less frequent dosing of antibody therapeutics in patients. Multiple studies have suggested that there is a correlation between FcRn binding affinity and antibody half-life, although the absence of such a correlation has also been reported.

Figure 21H:
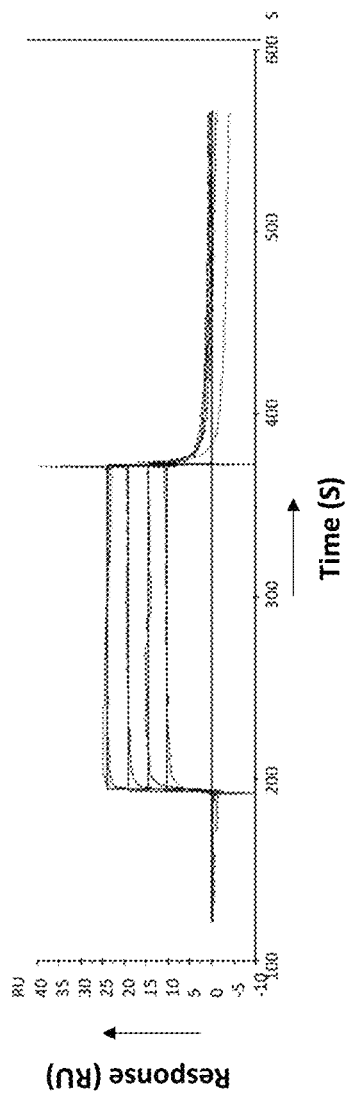
Figure 21I:
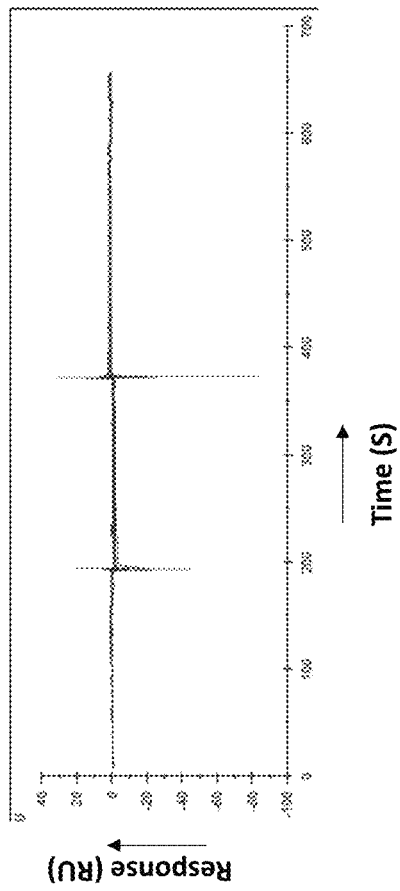

Binding kinetics and affinity studies between Human FcRn/FCGRT & B2M Heterodimer Protein and Anti-CLEC2D antibody binding studies were carried out using BIACORE 3000 instrument. Human FcRn/FCGRT & B2M Heterodimer Protein (Acro Biosystems) was immobilized onto CM5 chip surface at an RU of ~300. Human FcRn/FCGRT & B2M Heterodimer Protein was captured on CM5 chip surface through amine coupling, at a concentration of ~1 µg/mL, wherein the dilution of protein was made through running buffer comprising HBS-EP+ buffer (GE healthcare). Subsequently anti-CLEC2D antibody C5511 was passed at concentrations ranging from 0.0315 to 0.5 µM, at both pH 5.9 and pH 7.4. Antibody dilutions were made in HBS-EP+ buffer (GE healthcare). As can be seen from the response curve that there was no binding observed at pH 7.4 (FIG. 21H) while response was monitored at pH 5.9 (FIG. 21I). Response curves obtained were appropriately subtracted from reference flow cell signal and blanks, respectively and fit to a 1:1:1 Langmuir binding leading to estimated KD of ~$1.88 \times 10^6$ M−1. As can be concluded that no binding at neutral pH may increase the possibility of the anti-CLEC2D antibody to be released back into the blood stream.

Example 9: Anti-CLEC2D Monoclonal Antibody as a Diagnostic Tool/as Prognostic Marker Against Multiple Disease Indications All high binding anti-CLEC2D antibodies were screened to pick the top binder as diagnostic antibody. Among the 4 high binding anti-CLEC2D antibody, one was selected through antigen binding assay with PC3 tumor cell line.

Tumor cells expressing CLEC2D antigen were harvested by trypsinization. Cell count was taken by Vi-cell XR automated cell counter. Cells were centrifuged at 1400-1500 rpm for 4-5 minutes. The pellet was re-suspended in 1 ml DPBS. 50,000 cells were aliquoted in each well of a 96 well plate. 1 µg of C2779, C2438, C0949, C2543 were added to each well and incubated for 30-60 minutes at room temperature (25° C.). The plate was centrifuged at 1400-1500 rpm for 4-5 minutes, the supernatant was aspirated and cells were washed with 0.1% BSA in DPBS. 2.5 ml of 2% BSA was diluted to 50 ml with DPBS. Goat anti human IgG FITC conjugate was used as secondary antibody. 1:100 dilution of secondary antibody was prepared in DPBS and 100 µl was added to each well. The secondary antibody, Goat anti human IgG FITC conjugate, was used as control at 1:100 dilution for all relevant experimentation. The plate was incubated for 30 minutes at room temperature (25° C.) in dark. The cells were washed with 0.1% BSA and re-suspended in 100 µl of 1% BSA. Samples were analyzed by flow-cytometry.

Figure 22A:
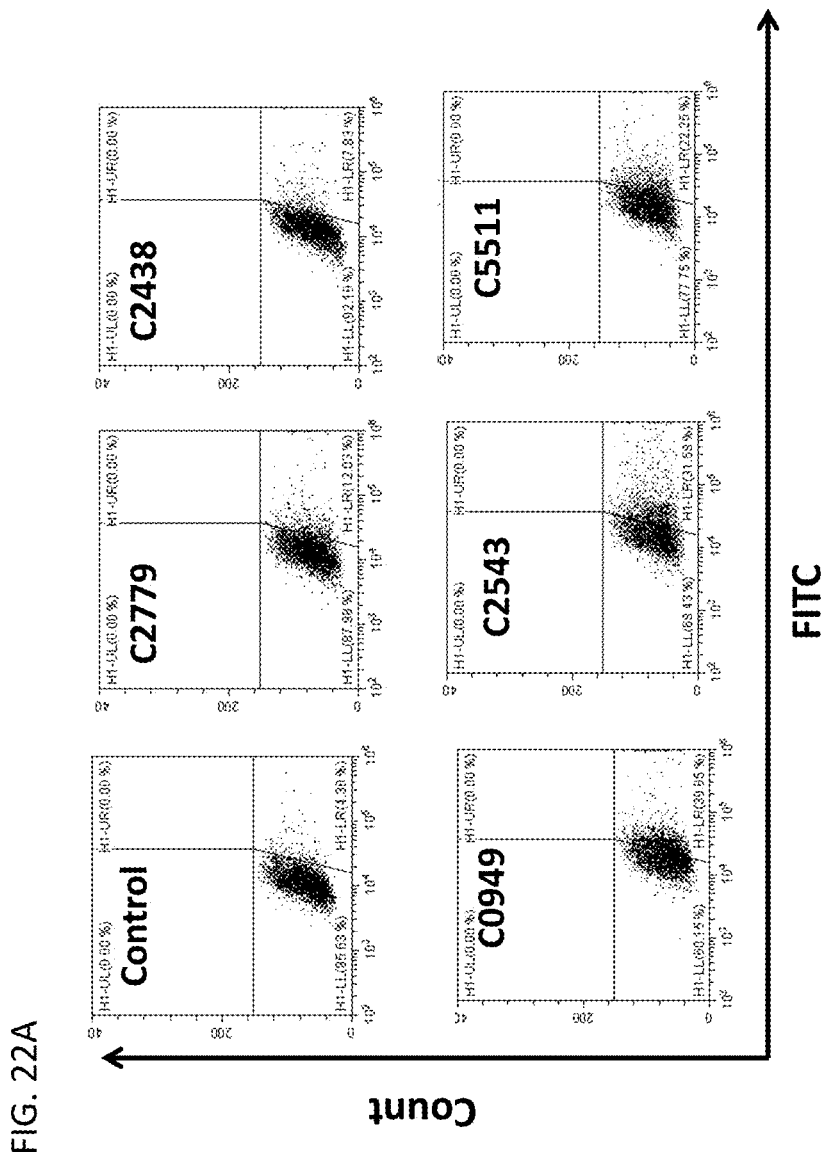

C0949 was selected as diagnostic antibody reagent due to maximum percentage of binding observed against surface expressed CLEC2D on PC3 when compared with other anti-CLEC2D clones (FIG. 22A) and purposed further to detect CLEC2D antigen on various tumour cell lines.

Figure 22C:
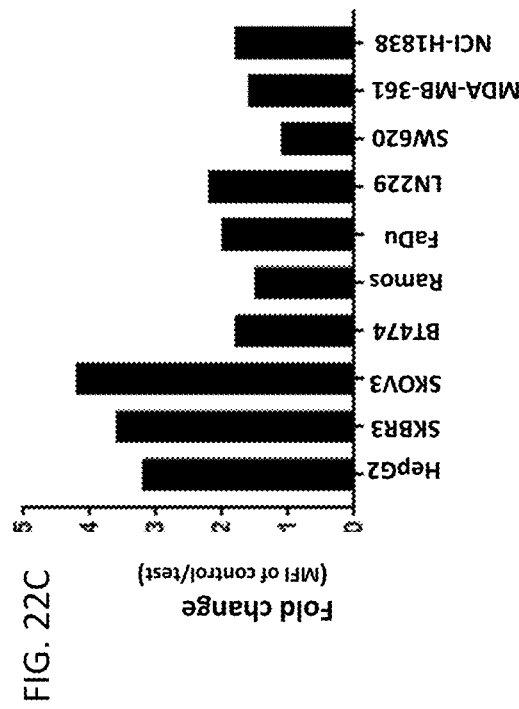
Figure 22B:
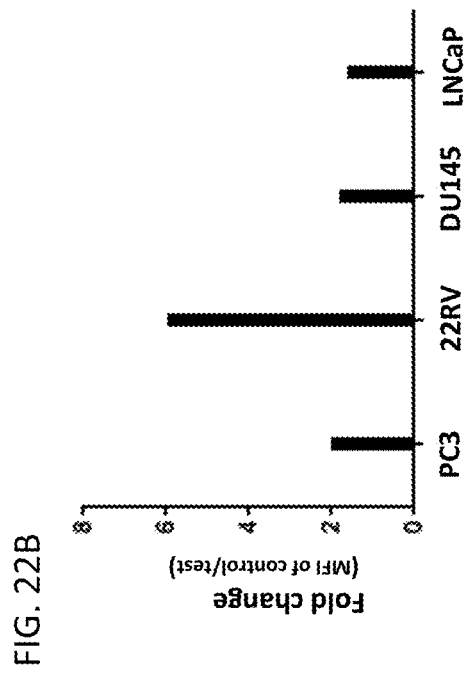

Among the prostate cancer cell lines, 22RV showed highest antigen expression with 5 fold increase as compared to secondary antibody control (FIG. 22B). Further, diagnostic anti-CLEC2D antibody, not limited to C0949, was used in antigen binding assay for multiple tumor cell lines of several disease indications shown in FIG. 22C.

Efficient and sensitive binding as observed in multiple cancer cell lines including prostate cancer cell lines, using various anti-CLEC2D antibody clones, strongly support the candidacy of the said molecules as diagnostic/prognostic reagent.

Clinical Prospect of Anti-CLEC2D Monoclonal Antibody

Disease relevance: prostate cancer

TCGA Analysis

The cancer genome atlas (TCGA) data was metastatic prostate cancer was analysed to improve on the current understanding of genes involved in the disease progression along with the expression level of CLEC2D in prostate cancer patients.

The PRAD project is the TCGA's prostate cancer project and it contains data for 500 Cancer cases. The relevant sources of data that were analysed were limited to Gene Expression Quantification, which included HTSeq Count Data, miRNA Expression Quantification and Isoform Expression Quantification. Table 50 shows a case-wise breakdown of the occurrences of the above specified files in the data that was accessible for download from the data categories of interest.

TABLE 50

A breakdown of the cases based on the availability of different data files, such as tumor and normal files

| Description | Cases | Percentage |
|---|---|---|
| Transcriptome Profiling | | |
| No files | 2 | 0.4 |
| only miRNA + Isoform | 3 | 0.6 |
| only GEQ | 4 | 0.8 |

TABLE 50-continued

A breakdown of the cases based
on the availability of different
data files, such as tumor and normal files

| Description | Cases | Percentage |
|---|---|---|
| Transcriptome Profiling | | |
| all files, only Tumor | 436 | 87.2 |
| all files, Tumor + Normal | 52 | 10.4 |
| two different miRNA + Isoform Files | 1 | 0.2 |
| two different GEQ (tumor) files | 2 | 0.4 |

TCGA Data—Transcriptome Profiling

The transcriptome profiling data category contains counts of gene, miRNA and isoform expression. Of the 500 cases deposited in the TCGA, 498 have data associated with Primary Tumor tissue, while 52 cases have expression data related to the Normal Tissue. The files are a list of 60483 genes and their variants, denoted by their Ensembl IDs and their counts within each case.

TCGA Data—Metastatic Cases Identification

The 500 TCGA PRAD Project cases were parsed to identify cases which displayed characteristics that would lead to them being identified as cases of metastatic prostate cancers. A total of 289 cases were identified to be metastatic, this identification was made on the basis of key parameters, in other TCGA documentation which lists among other parameters Gleason Scores and prescribed Drugs. Of the 289, only 18 had relevant Normal Tissue data, as this analysis is concerned with the change in expression levels for before and after the disease, it was necessary to establish baseline values, Normal data, for the other genes as well. This was achieved by looking at all 52 Normal Tissue data, these were used to create a baseline file, by taking into account all 52 values from each case for each gene, removing outlier values, and calculating an 'normal baseline' value for the gene. For cases lacking a Normal Tissue counts, the baseline file was used for the comparative analysis.

TCGA Data—Metastatic Cases Sub-Groupings

The same key parameters which served as the basis of the Metastatic case identification were also used to segregate the data into other sub-groupings such as stage of the cancer and current treatment regimen—this data was used to analyse the CLEC2D Expression levels among the sub-groups Subsequently expression of CLEC2D gene was monitored wherein all the associated FPKM files from the projects were downloaded and specifically queried for CLEC2D expression. The FPKM files were made up of Tumor expression files and in some cases Normal Tissue Expression files. Both sets were separately used to calculate a range for CLEC2DCLEC2D Expression for each cancer among Normal and Tissue cases. Additionally outliers were omitted from the data by assuming a normal distribution of the Expression values and discarding values that were more than 2 standard deviations away from the mean.

Figure 23A:
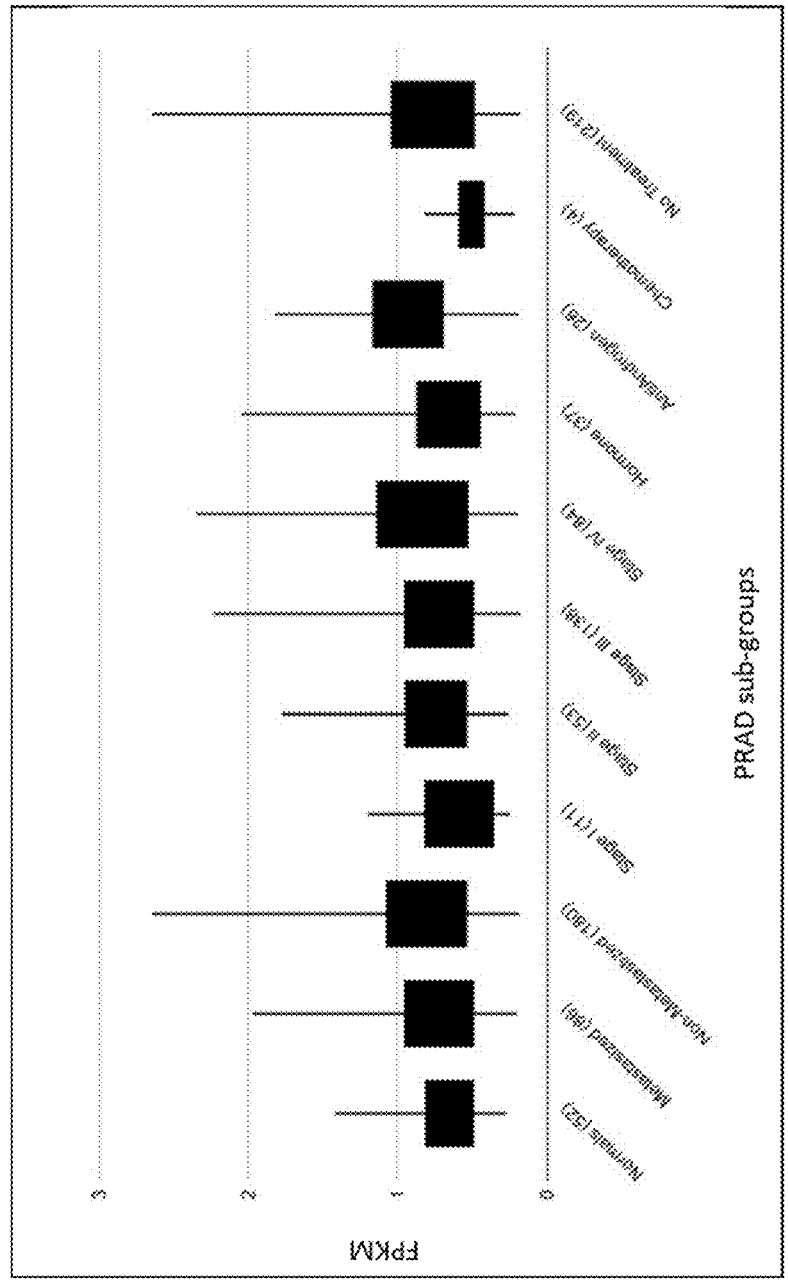

In order to better understand the role of CLEC2D in cancers the relative expression levels of the gene in normal tissue samples and tumor tissue samples was analysed. This was done by collecting all the case data for specific cancers/conditions and retrieving the CLEC2D expression value from each file before analysing the sets of values. For each subset the 'spread' of the CLEC2D expression profile was plotted by looking at the minimum, maximum and inter-quartile values. As can be seen from FIG. 23A, CLEC2D appears to conform remarkable existence in terms of expression level seen in different subsets conditions, such as, metastasis, tumor stage and treatment received, amongst others.

Induction Driven Expression Increase

In order to determine the expression label of CLEC2D on the surface of different tumor cell lines, firstly surface expression of CLEC2D on the surface of CLEC2D transfected HDCHO, C4548, was looked at and distribution of same was observed on the transfected cells by using commercially available anti-CLEC2D (4C7) antibody. Assuming translation of CLEC2D could be heavily regulated upon various kind of inductions, various prostate cancer cell types were induced with multiple inducers such as effector cells (either whole PBMC or supernatant of PBMC) or activators of NK cells (e.g., LPS) on prostate tumor cell line (PC3) to monitor the impact on expression label of CLEC2D. Upon treatments with various inducers, an increased CLEC2D expression label was observed when compared to the untreated target cells.

Figure 23B:
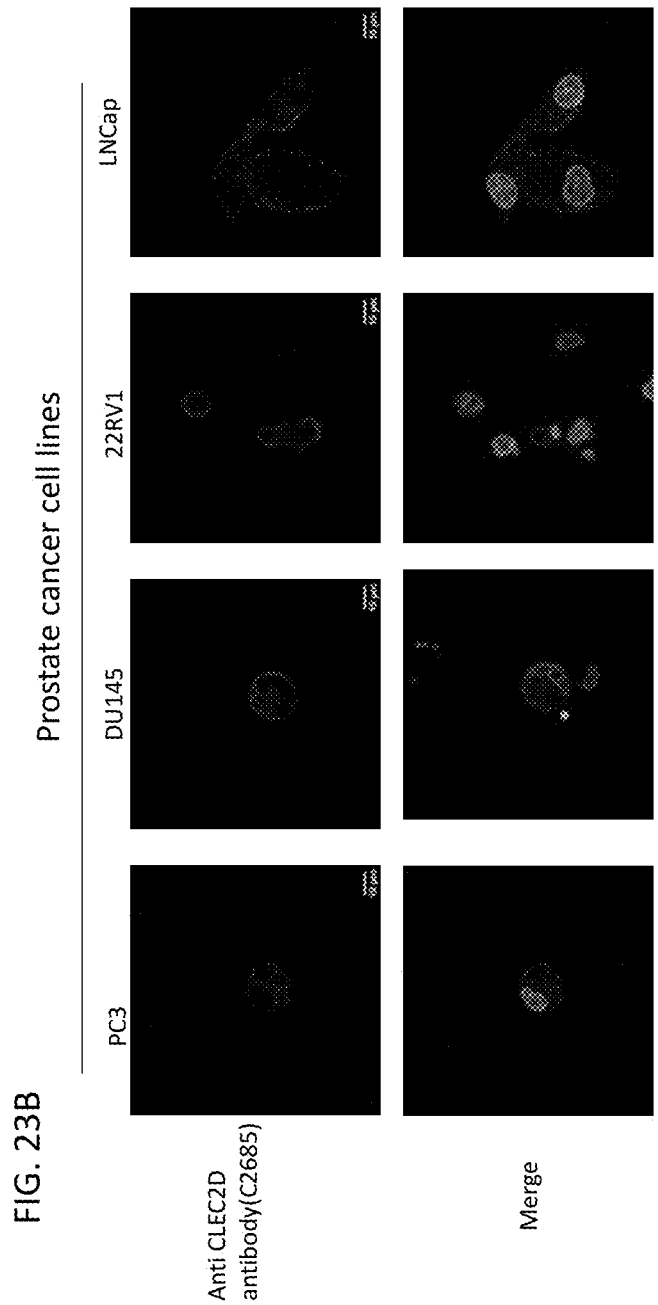
Figure 23C:
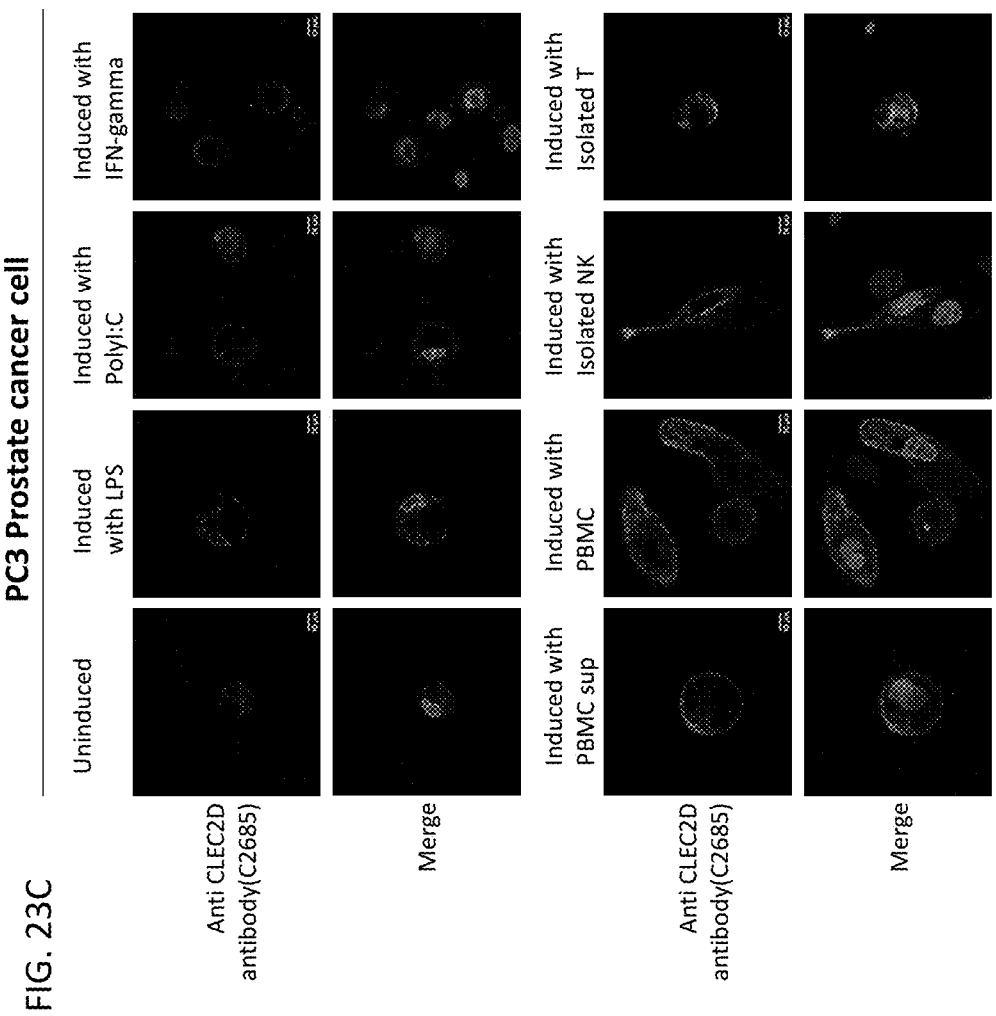
Figure 23C:
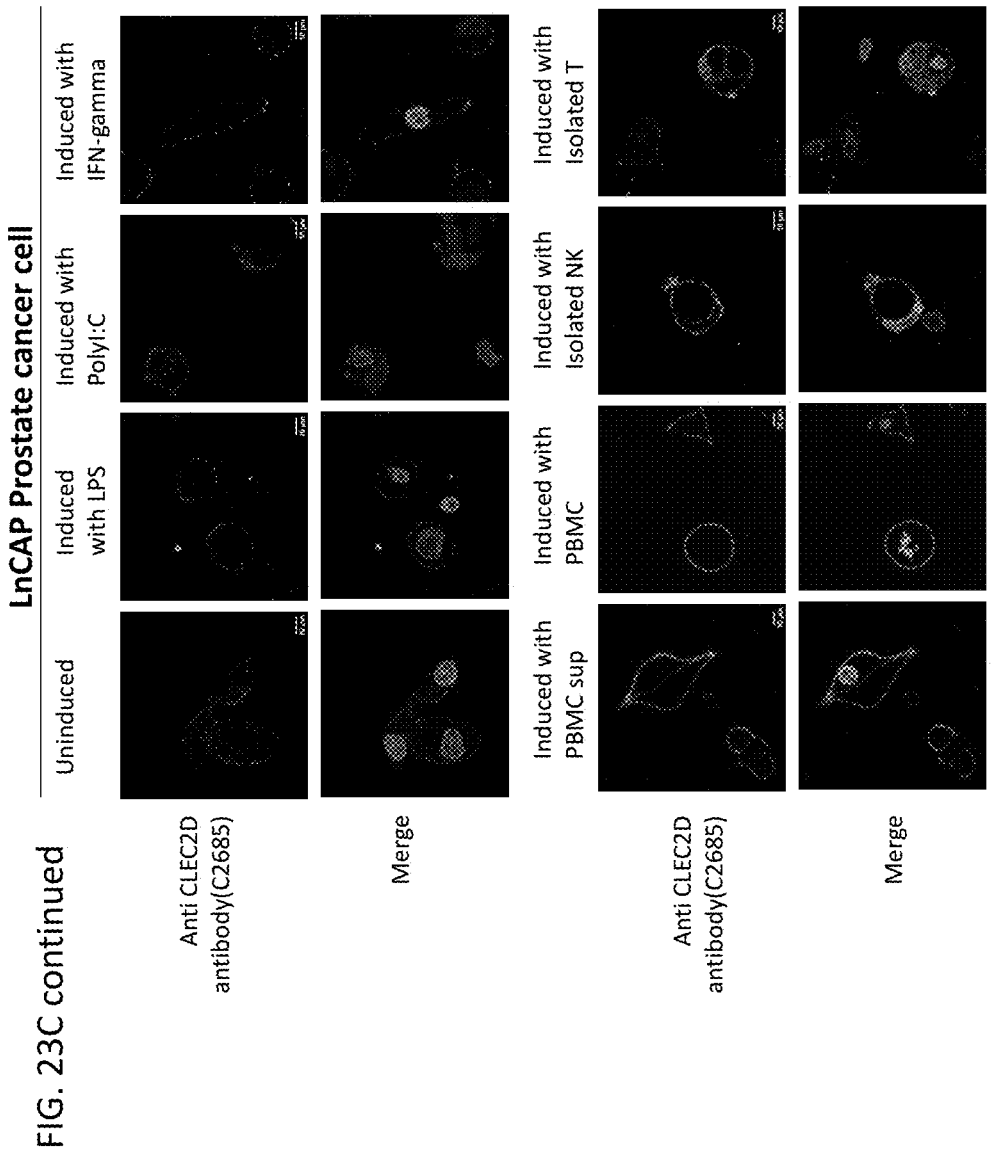
Figure 23C:
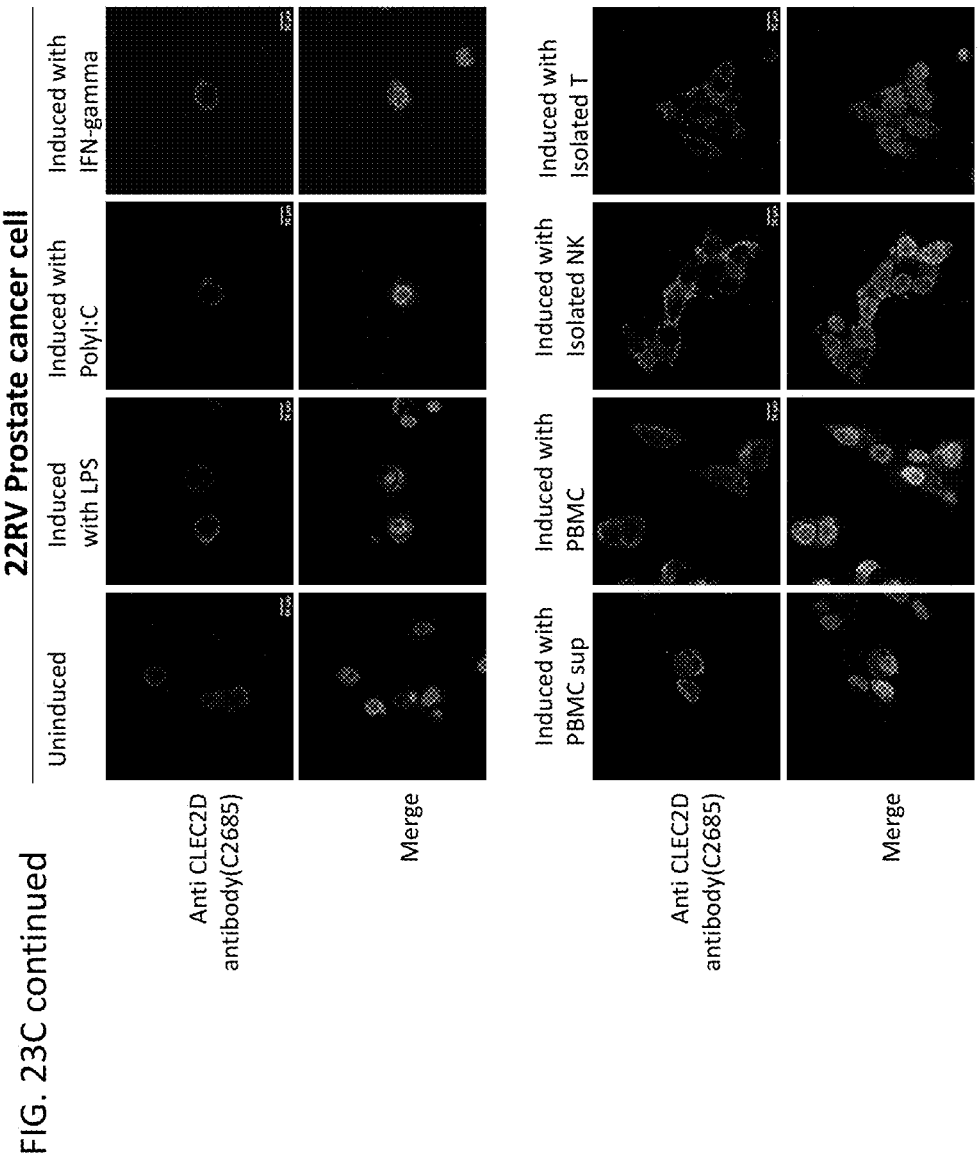
Figure 23C:
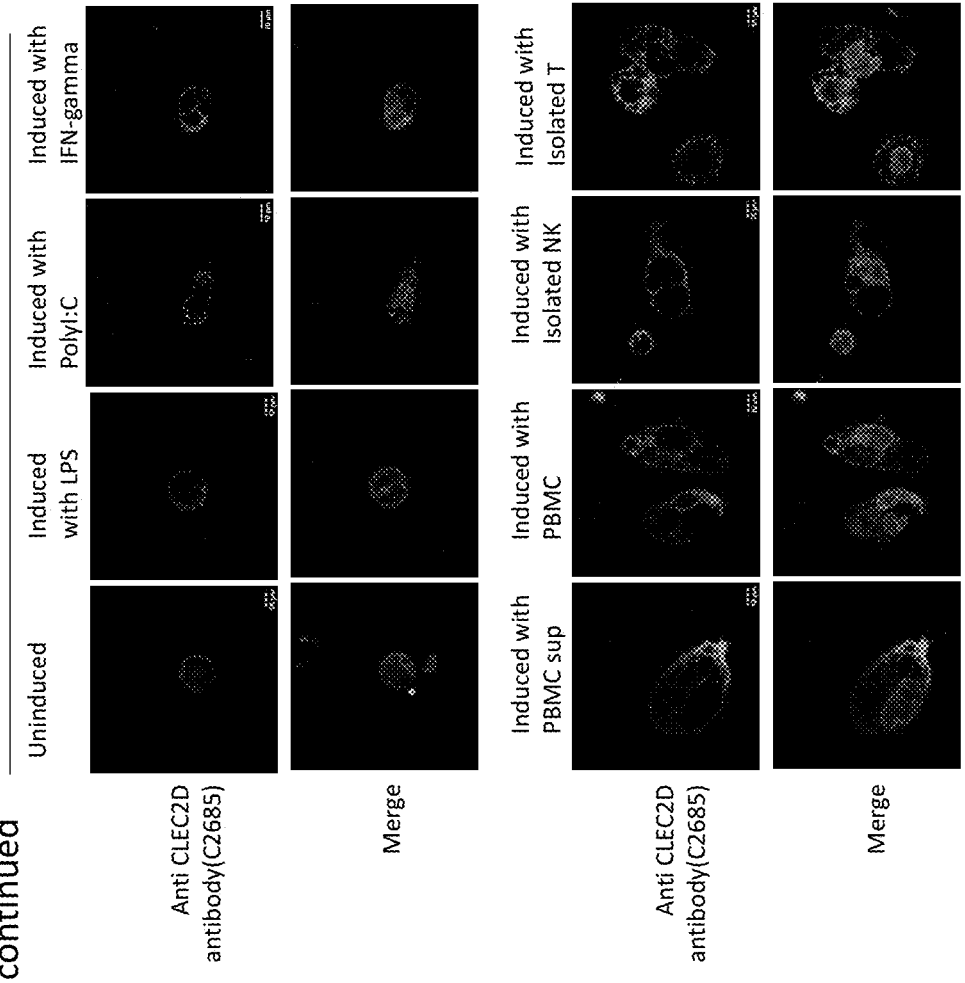

Among the prostate tumor cell lines under no induction, castrate-resistant prostate cancer (CRPC) cell lines i.e. PC3 and DU145 have high CLEC2D surface expression compare to Non-CRPC cell lines i.e. LNCap and 22RV1 wherein the CLEC2D was probed by using Novel anti-CLEC2D antibody as exemplified by, not limited to, C2685 clone (FIG. 23B). Extending the observation obtained in uninduced condition, the therapeutic anti-CLEC2D antibody, such as C2685, not limited to, was used to understand the changes in expression level in the presence or absence of inducers. Next, in order to look into the changes in expression label of CLEC2D on all prostate tumor cell lines upon various treatments, prostate tumor cells were incubated with effector cells (either whole PBMC or supernatant of PBMC or isolated NK cells or isolated T cells) or with activators/inducers of NK cells (either LPS or Poly I:C or IFN gamma), and examined the expression label of CLEC2D by using C2685 anti-CLEC2D antibody. Upon treatment an increased expression label of CLEC2D was observed when compared with the untreated target cells (FIG. 23C). Among the prostate tumor cell lines, castrate-resistant prostate cancer (CRPC) cell lines i.e. PC3 and Non-CRPC cell line i.e., LNCap have shown further enhancement of CLEC2D surface expression upon treatment compare to DU145 and 22RV1 treated with said inducers (FIG. 23C).

Considering all and having specific focus on prostate cancer, cell lines such as, castrate-resistant prostate cancer (CRPC) cell lines (such as PC3 and DU145) and Non-CRPC cell lines (such as LNCap and 22RV1), revealed significant expression level of CLEC2D antigen on tumor cell surface, which was further increased with various treatments, including multiple TLR treatments. The choice of cell lines were strategic, as all prostate cancer cell lines used herein signifies certain stage or condition of prostate cancer disease and can be associated with CLEC2D expression level. As described and shown in the present disclosure, prostate cancer cell lines, LNCaP, DU145, 22RV1 and PC3 have low, moderate and high metastatic potential wherein PC3, with high cell surface CLEC2D expression, is effectively killed by NK cells when the inhibitory signal through CLEC2D-CD161 axis is blocked using identified anti-CLEC2D antibody, thereby, establishing CLEC2D as clinically relevant target for prostate cancer.

Example 10: Expression of CLEC2D Antigen in Cancer Tissue

CLEC2D has been described as a multi-functional protein, and to fully elucidate the functional consequences of its interactions with its receptor, CD161, a comprehensive characterisation of CLEC2D distribution is needed. CLEC2D has been observed to be activated in different tumor cell lines and present on various immune cells in humans. CLEC2D can be detected in several healthy human tissues, and can be remarkably prevalent in immune-privileged sites. This information will be used to emphasize and postulate on the role of CLEC2D in cross talk between lymphocytes and immune tolerance.

The tissue microarray (TMA) represents a high-throughput technology for the assessment of histology-based laboratory tests, including immunohistochemistry and fluorescent in-situ hybridization (FISH). For immune-fluorescent staining, anti-CLEC2D monoclonal antibody is used as primary antibody and either direct labelling or indirect labelling, with a labelled secondary Ab, is used for detection. Thus, the role of CLEC2D is determined in various cancers and in the context of various stages of cancer.

Additionally, 3D cell culture methodology is used to understand the interaction of tissue expressed CLEC2D antigen with human immune system to determine the crosstalk between CLEC2D antigen and interacting partners (including CD161) expressing on tumor cells, and immune cell types, such as B cells, T cells, monocytes and NK cells.

Having described embodiments of this disclosure with reference to the accompanying drawings, it is to be understood that this disclosure is not limited to the precise embodiments, and that various changes and modifications may be effected therein by those skilled in the art without departing from the scope or spirit of this disclosure as defined in the appended claims.

Human tissue microarray from US Biomax (cat number TP242d), top 4 types of cancer (colon, breast, lung and prostate) tissue array with normal tissue, including TNM and pathology grade, 24cases/24 cores were used to analyse reactivity of anti-CLEC2D antibody clones C0694 and C2685. The prostate cancer samples are as follows.

Expression values and discarding values that were more than 2 standard deviations away from the mean.

TABLE 52

A List of the Cancers analysed for CLEC2D Expression.

| | |
|---|---|
| ACC | Adrenocortical Carcinoma |
| BLCA | Bladder Urothelial Carcinoma |
| BRCA | Breast Invasive Carcinoma |
| CESC | Cervical Squamous Cell Carcinoma and Endocervical Adenocarcinoma |
| CHOL | Cholangiocarcinoma |
| COAD | Colon Adenocarcinoma |
| DLBC* | Lymphoid Neoplasm Diffuse Large B-cell Lymphoma |
| ESCA | Esophageal Carcinoma |
| GBM | Glioblastoma Multiforme |
| HNSC | Head and Neck Squamous Cell Carcinoma |
| KICH | Kidney Chromophobe |
| KIRC | Kidney Renal Clear Cell Carcinoma |
| KIRP | Kidney Renal Papillary Cell Carcinoma |
| LAML | Acute Myeloid Leukemia |
| LGG | Brain Lower Grade Glioma |
| LIHC | Liver Hepatocellular Carcinoma |
| LUAD | Lung Adenocarcinoma |
| LUSC | Lung Squamous Cell Carcinoma |
| MESO | Mesothelioma |
| OV | Ovarian Serous Cystadenocarcinoma |
| PAAD* | Pancreatic Adenocarcinoma |
| PCPG | Pheochromocytoma and Paraganglioma |
| PRAD | Prostate Adenocarcinoma |
| READ | Rectum Adenocarcinoma |
| SARC | Sarcoma |
| SKCM | Skin Cutaneous Melanoma |
| STAD | Stomach Adenocarcinoma |
| TGCT* | Testicular Germ Cell Tumors |
| THCA | Thyroid Carcinoma |
| THYM* | Thymoma |
| UCEC | Uterine Corpus Endometrial Carcinoma |
| UCS | Uterine Carcinosarcoma |
| UVM | Uveal Melanoma |

*denotes projects whose CLEC2D expression levels differed significantly from the rest.

TABLE 51

| Patient Age | Patient sex | Cancer | Pathology Diagnosis | TNM | Grade | Stage | Type |
|---|---|---|---|---|---|---|---|
| 71 | M | Prostate | Adenocarcinoma Gleason 2 (2 + 2) | T2N0M0 | 1 | I | Malignant |
| 73 | M | Prostate | Adenocarcinoma Gleason 4 (4 + 4) | T3N0M0 | 2 | III | Malignant |
| 60 | M | Prostate | Adenocarcinoma Gleason 3 (3 + 3) | T3N1M0 | 2 | IV | Malignant |
| 64 | M | Prostate | Adenocarcinoma Gleason 4 (4 + 3) | T3N0M0 | 2 | III | Malignant |
| 31 | M | Prostate | Prostate tissue | — | — | — | Normal |
| 35 | M | Prostate | Prostate tissue | — | — | — | Normal |

Figure 23D:
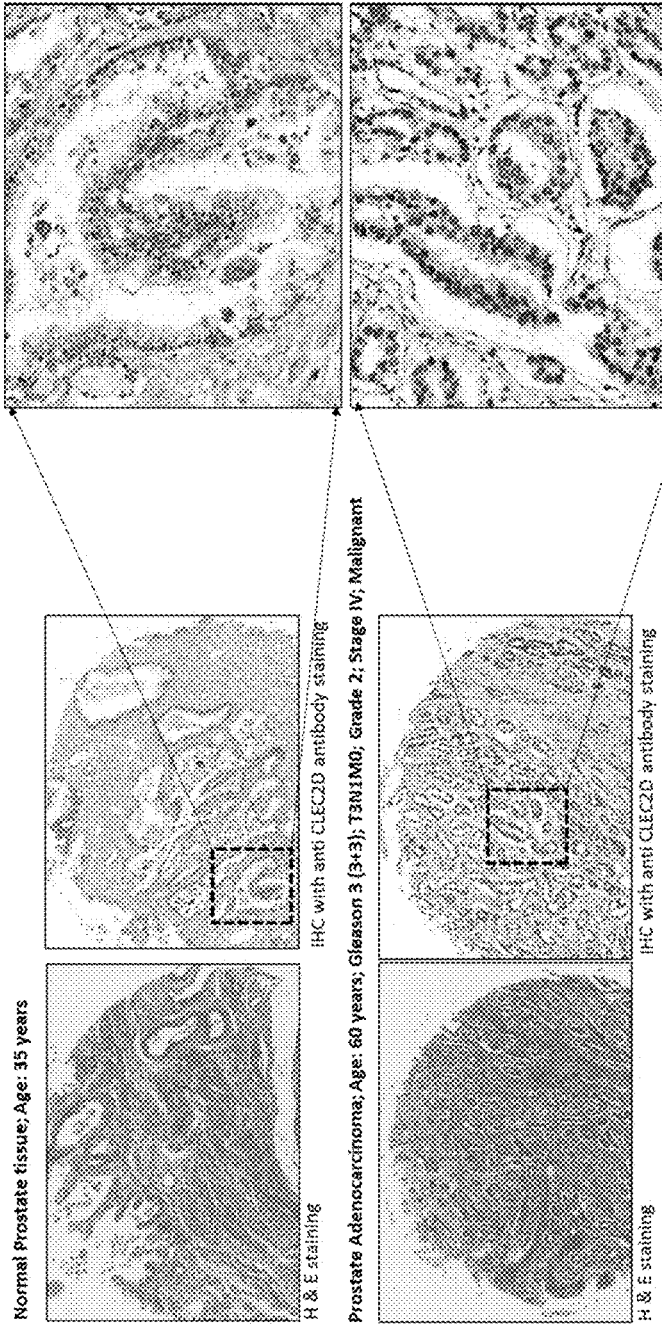

The IHC staining followed both CC1 and CC2 protocols at different concentrations of antibody from 1:10 dilution to 1:30 dilution. The data suggests C2685 revealed strong reactivity and less interference from negative regions. Results are described in FIG. 23D.

TCGA Data—all Cancers CLEC2D Expression

Figure 24A:
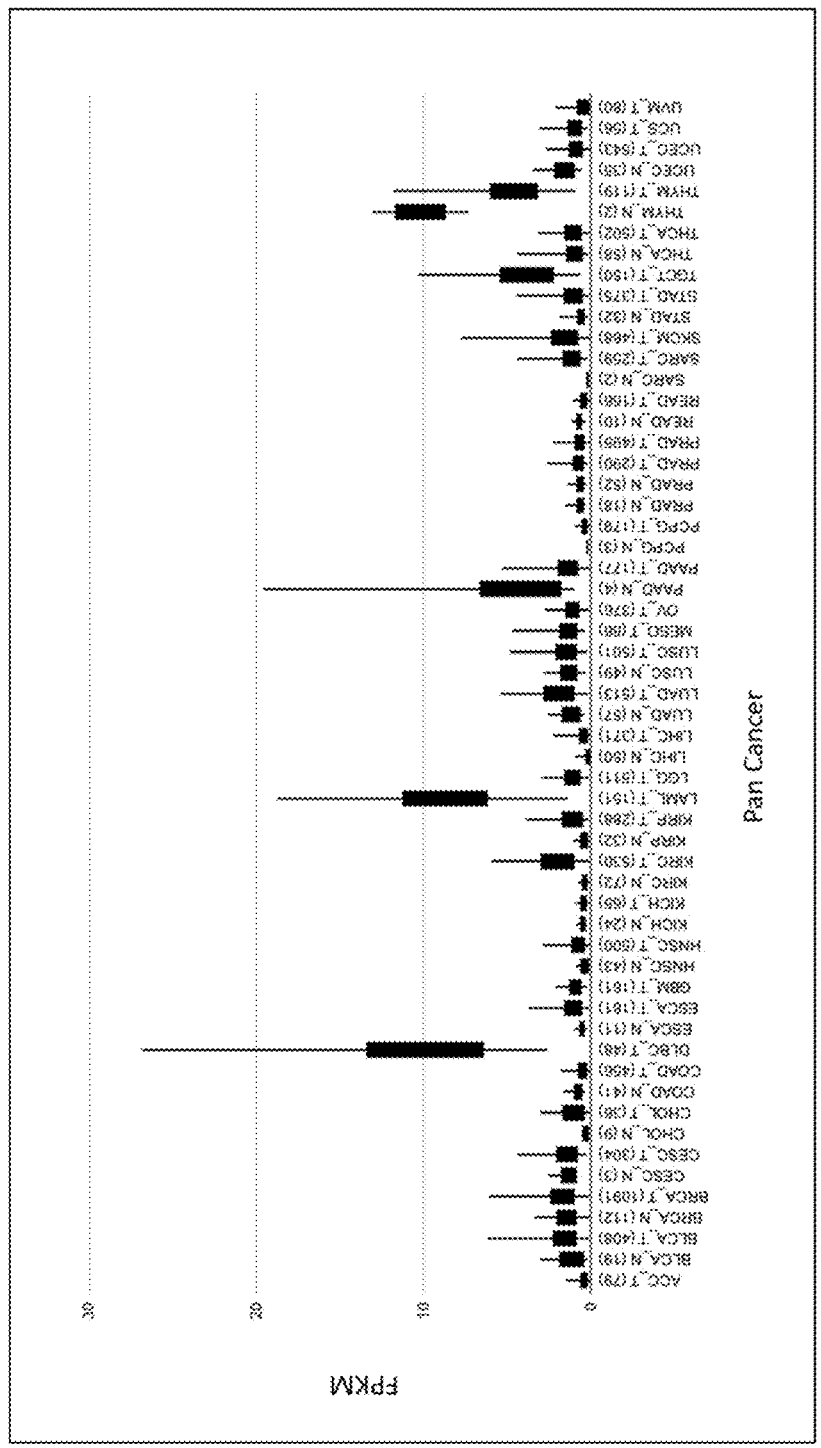

A pan-cancer analysis was carried out by studying all the TCGA cancer projects. All the associated FPKM files from the projects were downloaded and specifically queried for CLEC2D expression. The FPKM files were made up of Tumor expression files and in some cases Normal Tissue Expression files. Both sets were separately used to calculate a range for CLEC2D Expression for each cancer among Normal and Tissue cases. Additionally outliers were omitted from the data by assuming a normal distribution of the For each subset the 'spread' of the CLEC2D expression profile was plotted by looking at the minimum, maximum and interquartile values. As can be seen from FIG. 24A CLEC2D appears to conform remarkable existence in terms of expression level seen in different cancer conditions as listed in above table, amongst others.

Binding Studies: Flow Cytometry and Imaging

As observed in prostate cancer cell lines, the observations were extended to other tumour cell lines as well, using identified anti-CLEC2D antibody clones, as exemplified by C2685, C5511, amongst others. The binding was also monitored through both flow cytometry and confocal microscopy, wherein respective experimental conditions are similar to the description above.

Using anti-CLEC2D antibody C5511, flow cytometric observation have been summarized in the following Table 53.

TABLE 53

Bispecific antibody

| Tumor cell line | Disease indication | Binding fold change against Control (C5511) |
|---|---|---|
| HepG2 | Liver cancer | 1.5 |
| SKBR3 | Breast cancer | 1.8 |
| SKOV3 | Ovary cancer | 1.2 |
| BT474 | Breast cancer | 2.0 |
| Ramos | Lymphoma | 2.2 |
| FADu | Head & Neck squamous cell carcinoma | 1.2 |
| LN229 | Glioblastoma | 7.5 |
| SW620 | Colon cancer | 2.3 |
| MDA-MB-361 | Breast cancer | 3 |
| NCI-H1838 | non-small cell lung cancer | 2.3 |
| Capan-1 | Pancreatic cancer | 1.8 |

As can be understood, the expression level of CLEC2D on various cancer cell lines was found to be either low or moderate to high.

Figure 24B:
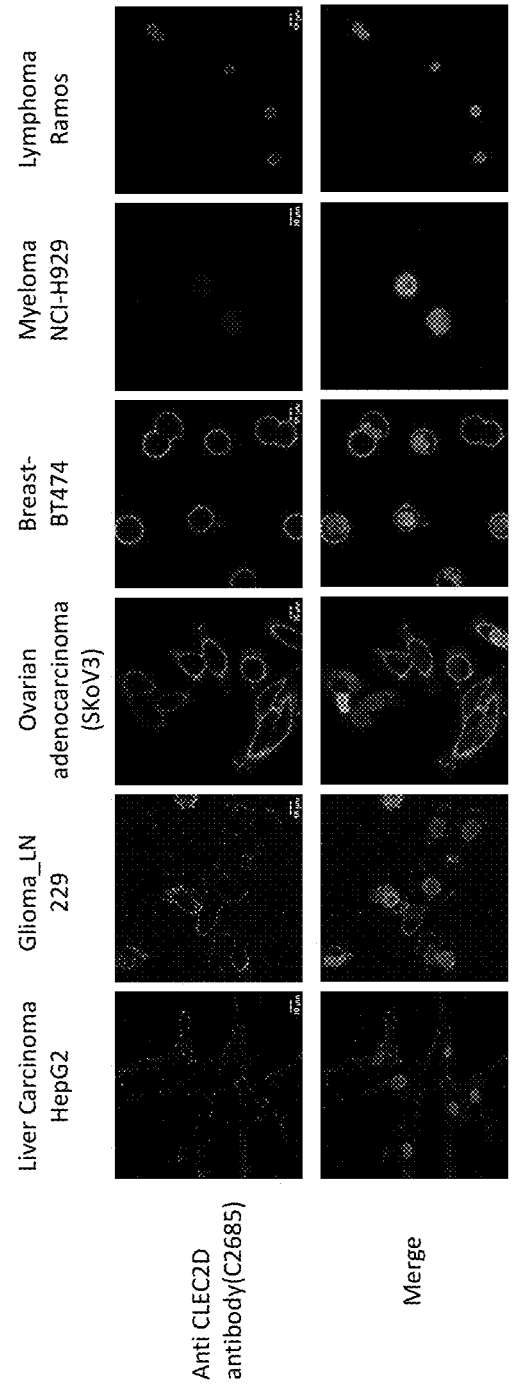

Similarly, in order to determine the disease relevance for novel antibodies we have checked the expression label of CLEC2D on the surface of different tumor cell lines such as liver carcinoma cancer, Glioma, ovarian adenocarcinoma, lung carcinoma, myeloma, lymphoma and breast cancer tough confocal microscopy. There are varying labels of expression of CLEC2D observed across the cancer cell lines tested by using anti-CLEC2D antibody clone C2685 (FIG. 24B). Predominant expression of CLEC2D was observed on the surface of hepatocellular carcinoma (HepG2), breast cancer (BT474), and glioma (LN229) whereas a very low or no expression observed in ovarian adenocarcinoma (SkoV3), myeloma (NCI-H929) and lymphoma (Ramos) (FIG. 24B).

Figure 24C:
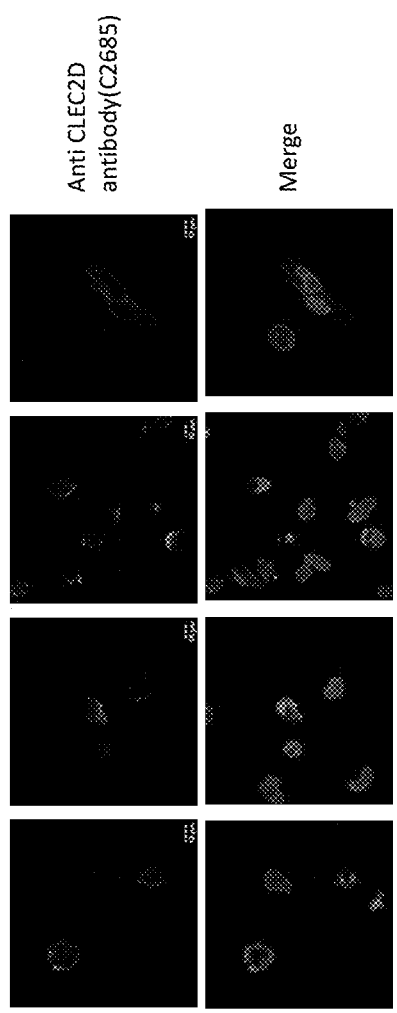
Figure 24C:
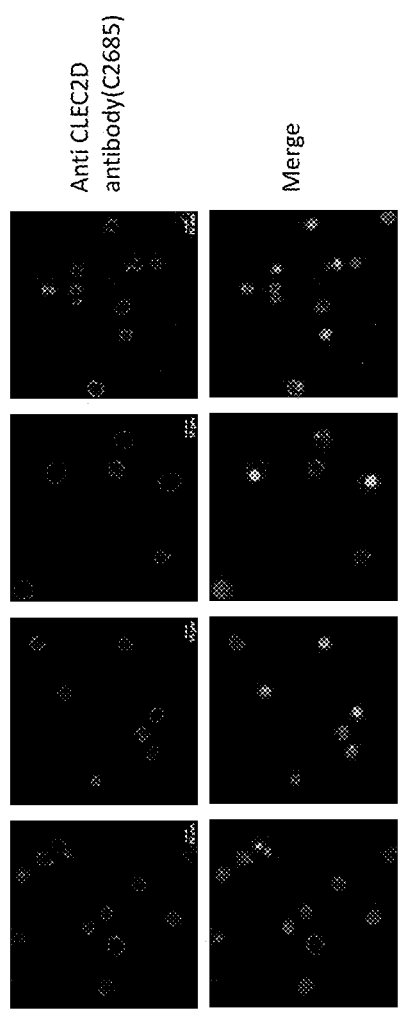
Figure 24C:
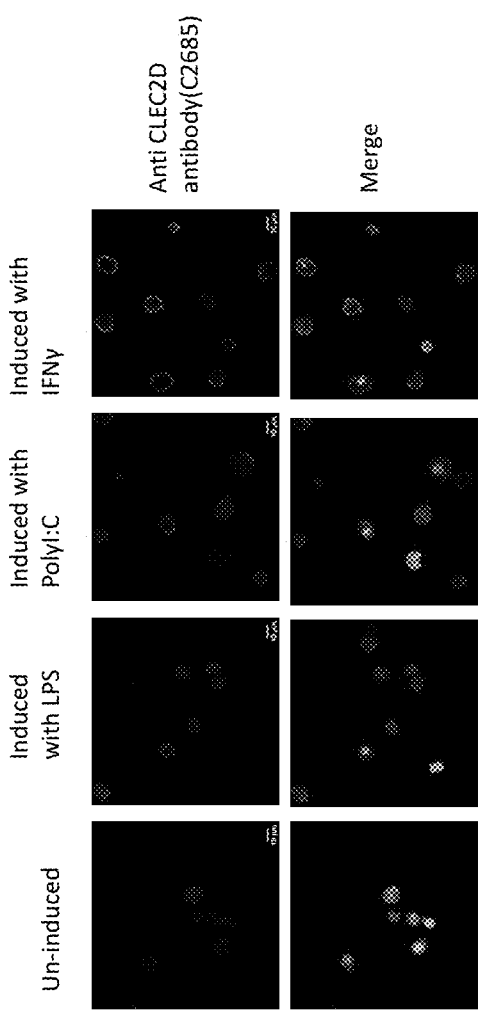
Figure 24C:
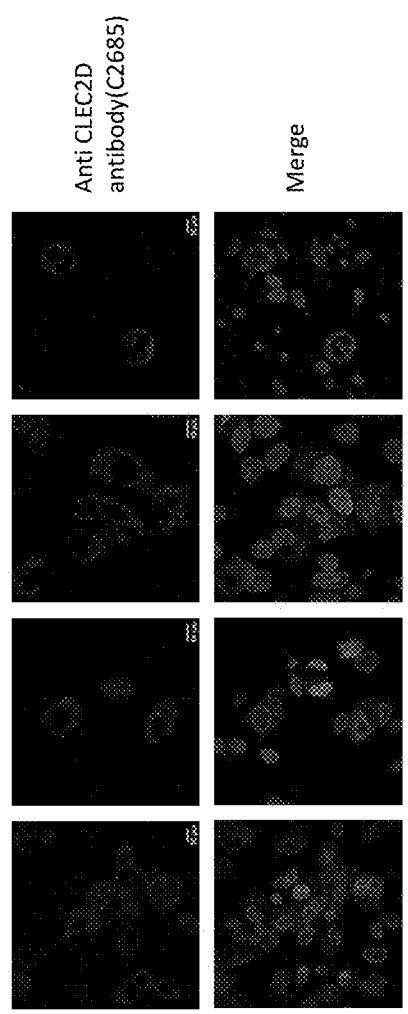

To check the regulation on the translation of CLEC2D in these cancer cell lines were induced with various inducers such as effector cells (either whole PBMC or soup of PBMC) or activator of NK cells (e.g. LPS), IFN-γ, poly I:C to all tumor cell lines (HepG2, BT474, LN229, SkoV3, NCI-H929 and Ramos) similar to prostate tumor cell line and monitored expression label of CLEC2D. Upon treatments, increased expression label of CLEC2D was observed when compared to the untreated target cells (FIG. 24C). Interestingly, on the SkoV3, NCI-H929 and Ramos cells have observed increased expression of CLEC2D upon treatment whereas on untreated cells have no/less expression (FIG. 24C). These finding indicates that CLEC2D is induced upon specific TLR stimulations on these cells and could be a potential target on these cancer conditions which can be targeted using anti-CLEC2D antibody.

Cytotoxicity

Figure 24D:
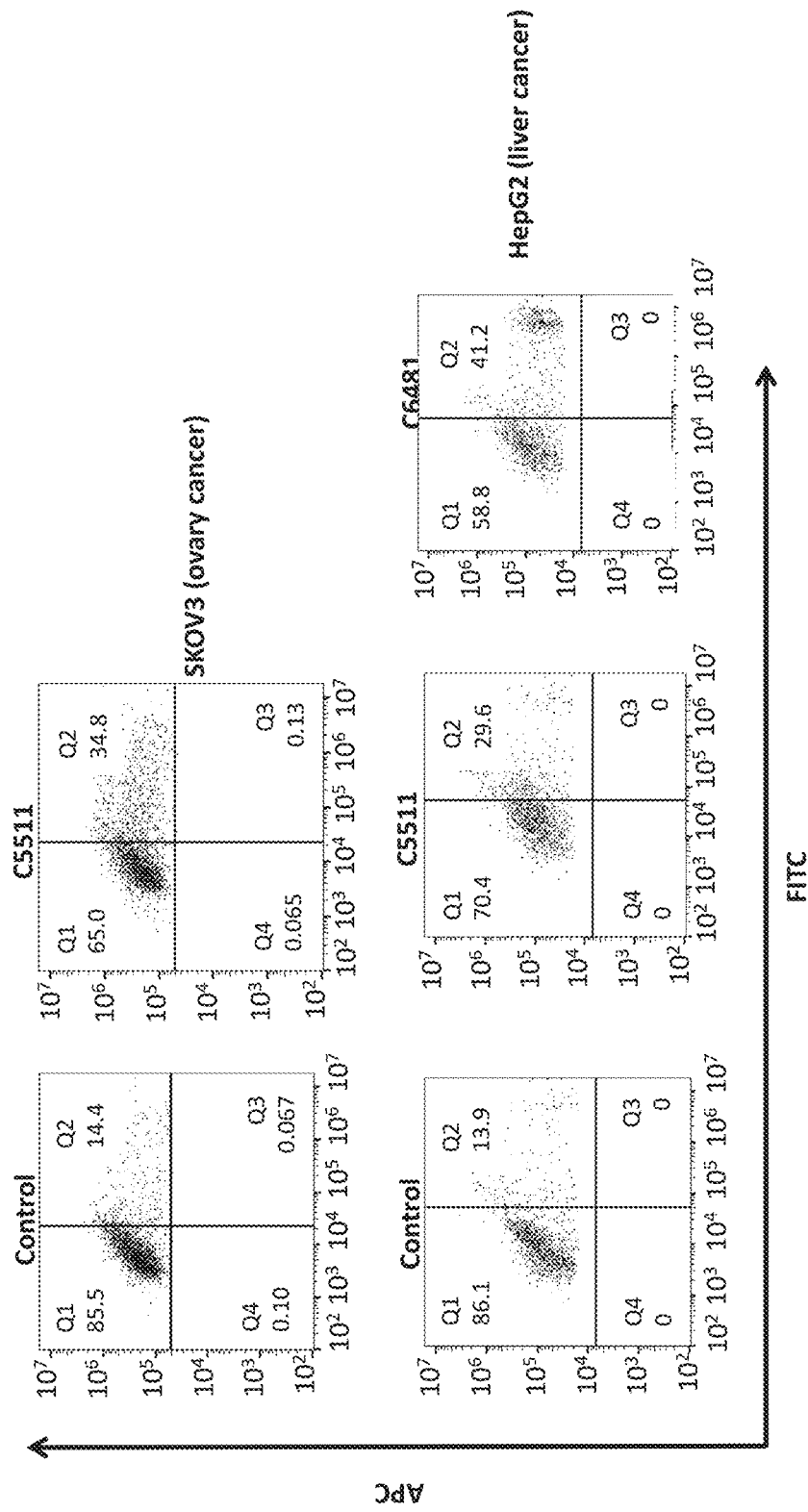

Tumour cell lines, as exemplified by SKOV3 (Ovarian cancer cell line), HepG2 (hepatocellular carcinoma) cells were labelled with Efluor as per the manufacturer's protocol and were seeded at a density of $0.04 \times 10^6$ in 20% DMEM in 24 well plates. After 24 hours, freshly isolated PBMCs were added in T:E of 1:5. Novel monoclonal anti-CLEC2D antibodies C5511 were added at 200 µg/ml in the assay reaction of 0.5 ml and incubated for 14 hours. Supernatant was collected from 24 well plate and adherent cells were trypsinized and collected in 1.5 ml tubes. Reaction mixture was incubated with sytox green (15 nM) for 20 min and fluorescence was detected in flow cytometer. Percent specific cell death was determined by subtracting the percent cell death of control from the test samples and showed significant cytotoxicity in ovarian (SKOv3) and liver (HepG2) (FIG. 24D) cancer cell lines indicating antitumor activity of anti-CLEC2D antibody against multiple diseases.

As can be understood, isolated anti-CLEC2D antibody that were used to monitor CLEC2D surface expression on several cell lines associated with diseases, such as breast cancer (BT474), lymphoma (ramos), liver cancer (HepG2), prostate cancer (PC3, DU145, LNCAP and 22RV1) glioma (LN229) ovarian adenocarcinoma (SkoV3), myeloma (NCI-H929), is first-in-class in the space. Moreover, cytotoxicity elicited by the said anti-CLEC2D antibody reflects the fact that these anti-CLEC2D antibody could be potentially used as therapeutic avenue against respective diseases. Taken together, this also signifies that CLEC2D antigen expression is linked with multiple cancer cell lines and could play an important role in cancer biology, as speculated the present disclosure.

Risk Mitigation Studies Done with Anti-CLEC2D Monoclonal Antibody

Immunogenicity to protein based biotherapeutics is a complex process involving numerous factors specific to products, including critical feature such as quality of drug, and patients. These critical quality attributes may include: variations in the primary sequence, host-cell specific post-translational modifications, the presence of host cell proteins, formulation changes, aggregation, chemical modifications (oxidation, deamidation, or glycation), and changes in protein structure. Some critical quality attributes of antibody drug products have been suggested to affect patient safety through enhancing the sequence based risk of immunogenicity, although the exact contribution of specific types of attributes is not known. T-cell dependent responses are the primary drivers of the long-term affinity matured immune response to biologics in the clinic. These include assay systems using: whole blood, peripheral blood mononuclear cells (PBMC), CD8+-depleted PBMC, immortalized cell lines, dendritic cells/monocytes/macrophages co-cultured with autologous CD4+ Tcells, and artificial lymph node systems, to name a few. Various biological outcomes can be measured at different stages of immune cell activation in these in vitro assays including, cytokine secretion, expression of cell surface markers of activation, identification of HLA-DR bound peptides, signal transduction events, phagocytosis by antigen presenting cells (APC), and proliferation. The application of the designated assay to the development of biopharmaceuticals can range from candidate selection at the early development phase to the late stage evaluation of specific attributes that may impact the risk of immunogenicity. Present disclosure details on attempts to evaluate anti-CLEC2D antibody associated risk towards immunogenicity or related attributes.

Lymphocyte Proliferation Studies

Proliferation of lymphocytes were tested by three independent experimental protocols such as, wet coating of antibodies, air dried coating of antibodies and high density PBMC pre-culture followed by induction with test antibodies, detailed as follows:

Wet Coating of Antibodies

Different concentrations of test antibodies, not limited to C5511, ranging from 1 µg/ml to 100 µg/ml and 1 µg/ml of the positive control—anti CD3 antibody, anti OKT3 antibody, were added to the wells of a 96 well flat bottom plate and incubated in a 37° C. incubator for 2-3 hours. After that the wells were washed three times with 200 µl of DPBS. PBMCs were labelled with Efluor 670 viable cell dye as per manufacturer's protocol. 30000 PBMC cells were seeded in each well in total 200 µl growth media (RPMI-1640 with 10% FBS). Day 0 samples were collected and analyzed by flow-cytometry. Cells were incubated at 37° C. in a 5% CO2 incubator for 4 days. On 4th day samples were collected, stained with anti CD4 antibody-FITC conjugate and analyzed by flow-cytometry.

Air Dried Coating of Antibodies

Different concentrations of test antibodies ranging from 1 µg/ml to 100 µg/ml and 1 µg/ml of the positive control anti CD3 antibody OKT3 were added to the wells of a 96 well flat bottom plate and air dried in biosafety cabinet. Volume of antibodies were restricted to less than 50 µl for optimum air drying. PBMCs were labelled with Efluor 670 viable cell dye as per manufacturer's protocol. Once the wells were dry, 30000 PBMC cells were seeded in each well in total 200 µl growth media (RPMI-1640 with 10% FBS). Day 0 samples were collected and analyzed by flow-cytometry. Cells were incubated at 37° C. in a 5% CO2 incubator for 4 days. On 4th day samples were collected, stained with anti CD4 antibody-FITC conjugate and analyzed by flow-cytometry.

High Density Pre-Culture of PBMC for TCR Priming Followed by Induction with Antibodies in Solution PBMC cells were pre-cultured at 1×10^6 cells/ml and 10×10^6 cells/ml density for 48 hrs in growth media at 37° C. in a 5% CO2 incubator. After 48 hours PBMCs were labelled with Efluor 670 viable cell dye as per manufacturer's protocol. 1×10^6 PBMC cells/ml were seeded in each well in total 200 µl growth media (RPMI-1640 with 10% FBS). Different concentrations of test antibodies ranging from 1 µg/ml to 100 µg/ml and 1 µg/ml of the positive control anti CD3 antibody OKT3 were added to the wells containing PBMCs. Day 0 samples were collected and analyzed by flow-cytometry. Cells were incubated at 37° C. in a 5% CO2 incubator for 4 days. On 4th day samples were collected, stained with anti CD4 antibody-FITC conjugate and analyzed by flow-cytometry.

Sample Processing for Flow-Cytometry

PBMC samples were centrifuged at 200 rpm for 5 minutes. Supernatants were discarded and the cells were re-suspended in 100 µl of DPBS with 0.5% BSA along with anti CD4 antibody-FITC conjugate (1:100 dilution in final reaction). Cells were incubated for 30 minutes in dark. After that cells were centrifuged at 200 rpm for 5 minutes, removed the supernatant and re-suspended in 100 µl of DPBS with 0.5% BSA.

Figure 25A:
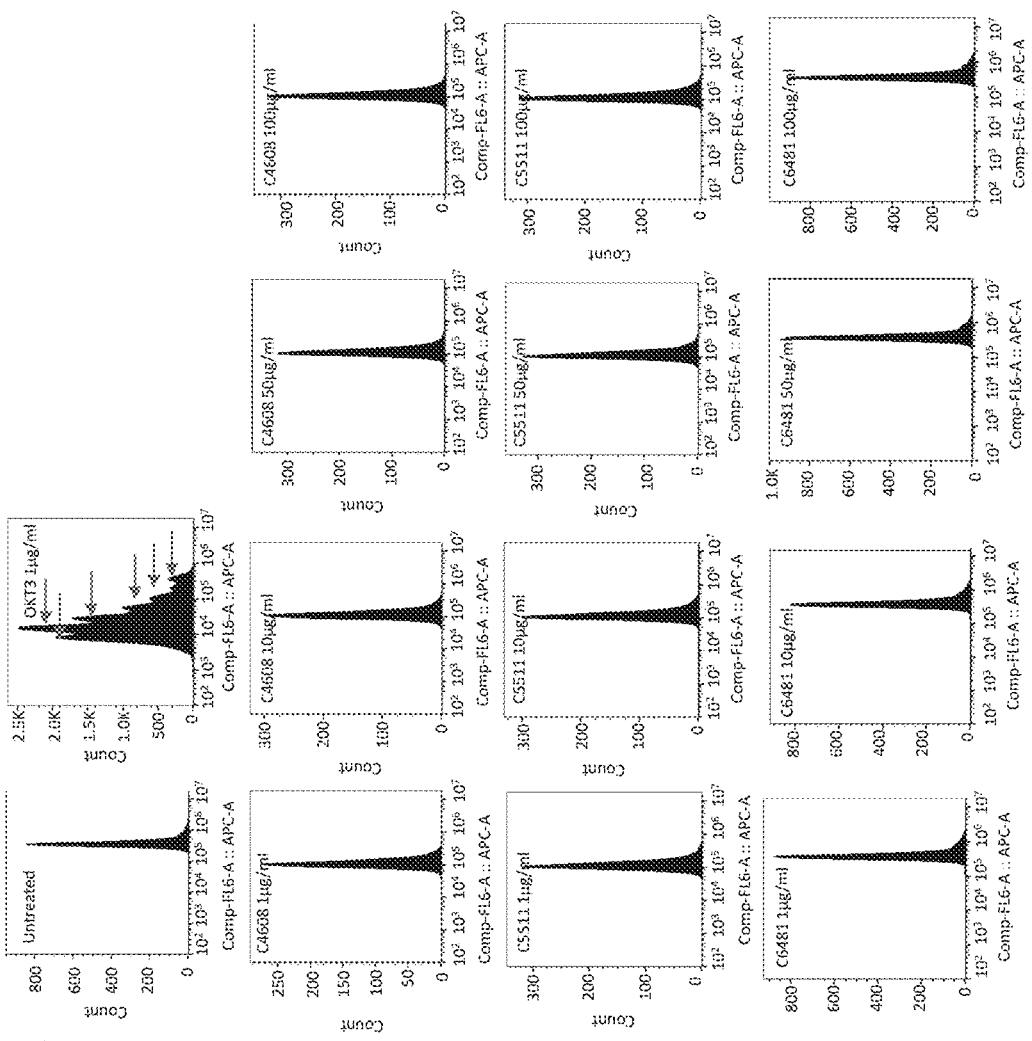
Figure 25B:
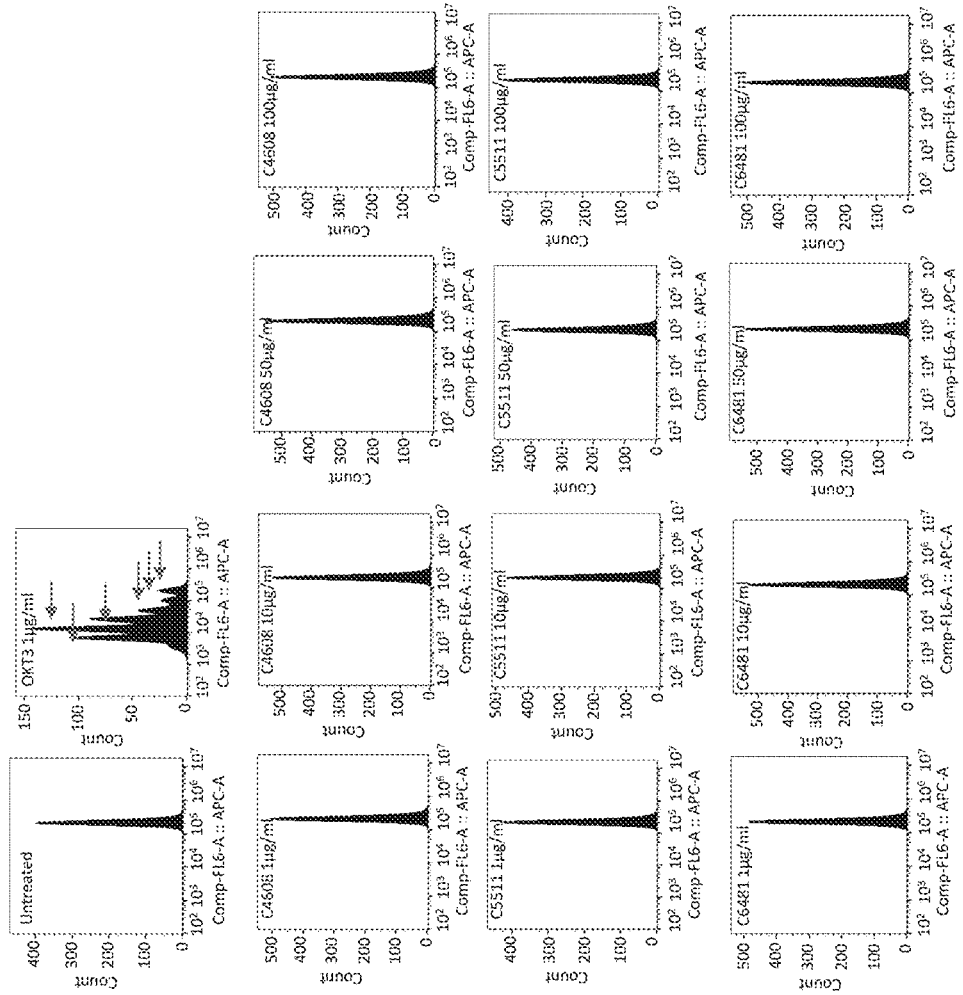
Figure 25C:
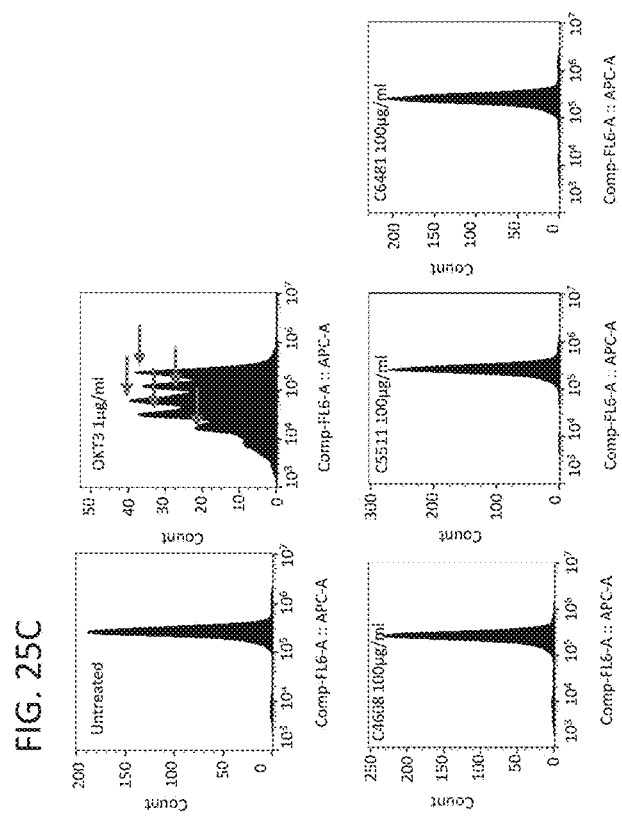

As can be observed from FIGS. 25A, 25B and 25C, wherein anti-CLEC2D antibody treatment was used as positive control, PBMC treated with anti OKT3 antibody showed lymphocyte proliferation as observed by partitioning of Efluor viability dye into multiple daughter populations (showed by the arrows on the histogram). Appearance of single population after 4 days of culture was observed in untreated PBMC control and 1 µg/ml to 100 µg/ml anti-CLEC2D antibody treated test samples, shows that anti-CLEC2D antibodies did not induce any lymphocyte proliferation. This observation was consistent with three independent test protocols that are wet coating of antibodies (FIG. 25A), air dried coating of antibodies (FIG. 25B) and high density PBMC pre-culture (FIG. 25C) followed by induction with test antibodies. PBMC from multiple healthy donors were tested and the results obtained were consistent.

Measurement of Secreted Cytokines: IFN-γ and IL2

As described earlier in the current segment, apart from understanding lymphocyte proliferation assay, it is essential to confirm whether Anti-CLEC2D antibody induces any cytokines, such as IFN-γ, IL2, or not. Measurement of secreted cytokines such as IFN-γ, IL2, not limited to, were performed through ELISA based detection method wherein supernatant collected from various experimental set up/conditions as detailed above e.g., high density, wet coating, was used at 24 hrs interval for subsequent quantitation. In all experiments concentration of respective antibodies used are anti OKT3 antibody (1 ug/ml) and anti-CLEC2D antibody clones such as C5511 C6481 C4608 at 100 ug/ml. Subsequently, supernatant obtained from anti OKT3 antibody treated sample was diluted in the ratio of 1:4 wherein 50 ul of supernatant was diluted by adding 150 ul of 10% RPMI 1640, on the contrary, anti-CLEC2D antibody treated samples were used directly without any further dilution of supernatant. Simultaneously, samples to measure cytokine IL2 was prepared by wet coating method. Herein anti OKT3 antibody treated sample was diluted in the ratio of 1:10 while 25 ul was diluted by adding 225 ul of 10% RPMI 1640, while supernatant collected from anti-CLEC2D antibody treated samples were used directly. Supernatant obtained from PBMC without treatment was used as control against respective experimentation either for IFN-γ or IL2.

Figure 25D:
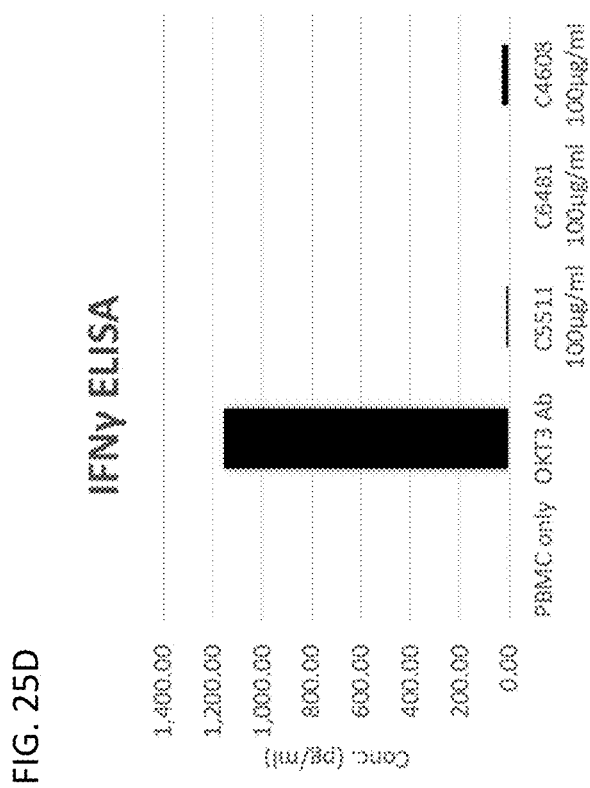
Figure 25E:
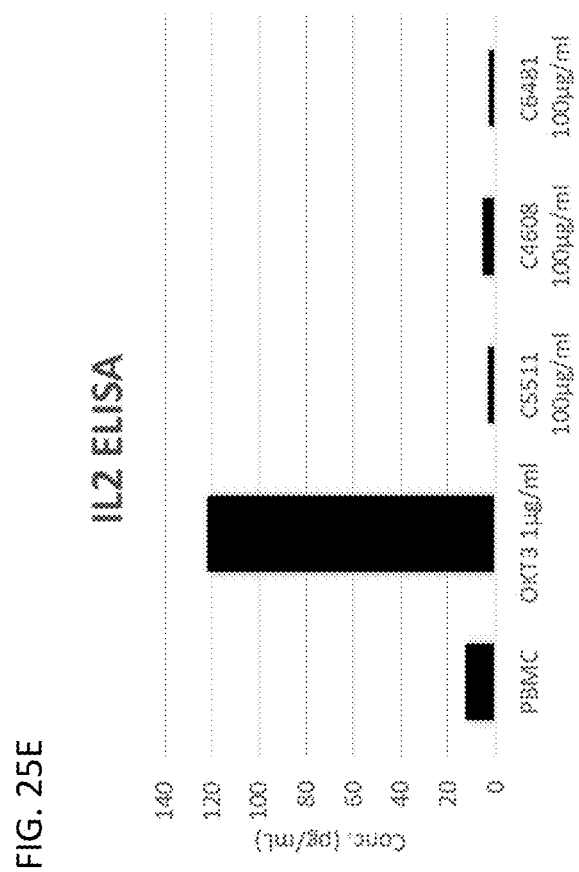

As can be seen from FIG. 25D, wherein PBMC treated with anti OKT3 antibody exhibited highest level of IFN gamma secretion in supernatant at a concentration of 1155 pg/mL while tested anti-CLEC2D antibodies did not elevate IFN gamma production beyond 30 pg/mL concentration, related to any anti-CLEC2D antibody clones (FIG. 25D). Similarly, for IL2 measurement anti OKT3 antibody induced elevation in secretion was found to be 121.50 pg/mL while anti-CLEC2D antibodies did not give rise to IL2 secretion more than 4.7 pg/mL (FIG. 25E). Taken together, identified therapeutic anti-CLEC2D antibody poses low possibility on immunogenicity reaction as judged by the lack of any T lymphocyte daughter population seen when treated with anti-CLEC2D antibody and also extremely low amount of cytokine secretion as observed with both IFN-γ and IL2.

Safety Study Performed with Anti-CLEC2D Monoclonal Antibody in Rat/Non-Human Primate Toxicology studies with therapeutic monoclonal antibodies should be carried out in a species that are pharmacologically relevant, meaning one that both expresses the target antigen recognized by the monoclonal antibody and evokes a similar pharmacological response following antibody binding, similar to that expected in humans. It is required to demonstrate comparable effector function of monoclonal antibodies in animals that can be extended to humans, especially for antibodies with relatively strong effector function, such as, IgG1. Thereby, the most sensitive animal model available for predicting human safety is utilized. However, cross-reactivity, or lack in cross reactivity, can be predicted through a detailed in silico analysis of sequence and structural understanding between the human antigen protein or targeted epitopes and the equivalent proteins in conventional species used for toxicology studies. It is advisable that toxicology assessment should be performed in two relevant species if available, one rodent and one non-rodent, while non-human primates (NHP), such as, cynomolgus monkey, is celebrated as the most suitable species to ethically justify its use and strategies minimizing primate use.

In silico understanding of comparative sequence analysis of CLEC2D antigens homologs from Human Rat, Mouse and Cynomolgus monkey, indicated that human CLEC2D antigen shares highest sequence homology (>90%) with cynomolgus monkey CLEC2D homolog while sequence homology against Rat and mouse homologs being less than ~70%. However, sequences were looked into in detail to identify the presence of the important residues which contacts antibody paratope sequence. The said exercise indicated that all species contain at least 70% of the contact points and interacting amino acid residues conserved and possibly available to interact with anti-CLEC2D antibody. Therefore efforts towards understanding the binding of anti-CLEC2D mono clonal antibodies was attempted through generating surface expressed CLEC2D antigen homologs from Rat, Mouse and cynomolgus monkey species. Flow cytometry based method was employed to assess the binding between antibody and CLEC2D antigen homologs.

As can be linked with SEQ IDs 886, 910, 911, 918, full length CLEC2D homologous sequences, from respective species were synthesized and cloned in pCDNA3.1, mammalian expression vector, which were transfected in CHO cells for binding studies through flow cytometry.

Transfection with Constructs of CLEC2D Antigen Variants for Homology Study

CHO suspension cells at more than 90% viability were used for expression of CLEC2D antigen variants. For 100 ml volume of transfection 1.25×10^8 cells were taken. Cells were centrifuged at 1000-1400 rpm for 4-5 minutes, decanted the spent media and re-suspended in 25 ml of OptiMEM I media. DNA constructs were transfected using Lipofectamine LTX with Plus™ reagent. 50-100 µg of respective pCDNA 3.1, constructs, were used with 1:3 to 1:6 DNA to transfection reagent ratio and 50-100 µl Plus™ reagent was used. DNA and Lipofectamine LTX complex was prepared in 25 ml OptiMEM I and incubated at 20-25° C. for 5 minutes for complex formation. The transfection mix was added slowly to the cell suspension. The cells were incubated for 4-6 hours at 37° C. in a 5% CO2 shaker Incubator at 100-120 RPM. 50 ml of Power CHO2 CD growth media was added to the cells. The cells were incubated at 37° C. in a 5% CO2 shaker Incubator at 100-120 RPM. 2-3 days post transfection 200 ml Power CHO2 CD growth media was added and Glutamax was added from 200 mM stock to achieve final concentration of 2 mM. The cells were incubated at 37° C. in a 5% CO2 shaker Incubator at 100-120 RPM. Cells were analyzed for cell surface antigen binding by flow-cytometry on day 3 to day 6 after transfection.

Figure 26:
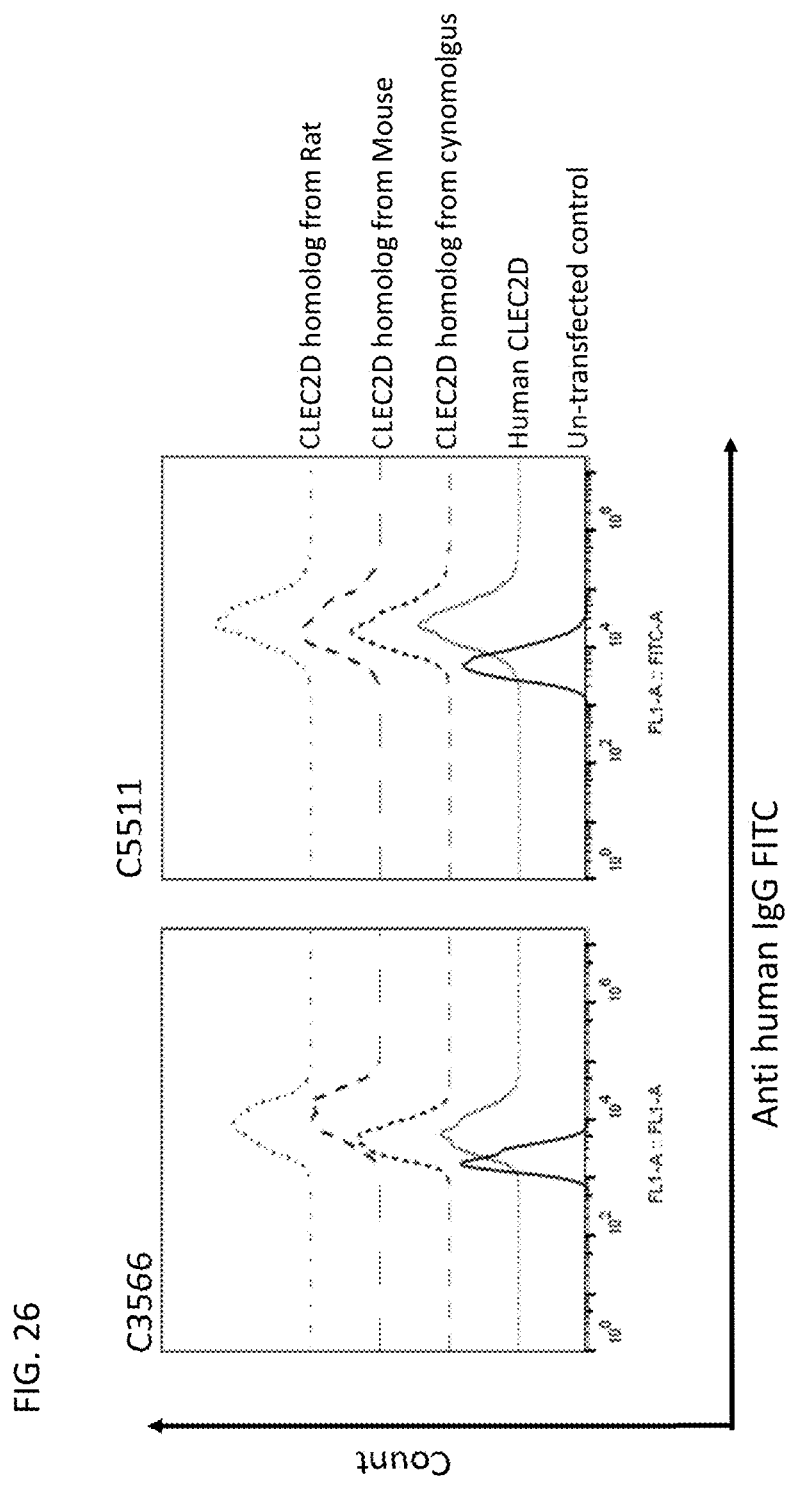
FIG. 26 illustrates histogram overlay showing binding of anti-CLEC2D antibodies (C3566 and C5511) against CLEC2D antigen homologs from Rat, Mouse and cynomolgus monkey, expressed on CHO cell surface, using flow cytometric analysis.

As can be seen in FIG. 26, Anti-CLEC2D antibody clones C5511, C4608, not limited to, developed against human CLEC2D antigen, and exhibited similar binding ranging from 2-4 fold of MFI. This indicates a broad specificity of anti-CLEC2D antibodies towards CLEC2D homologs in both rodent and non-human primate species.

TABLE 54

Amino acid sequence recognized by anti-CLEC2D antibody

| SEQ ID NO | Amino acid sequence recognized by anti-CLEC2D antibody |
|---|---|
| 2561 | GLU150-XAA151-THR152-ARG153-GLN154 |
| 2562 | ARG175-XAA176-TYR177-XAA178-GLU179 |
| 2563 | ARG101-XAA102-XAA-103-XAA104-SER105-XAA106-ASP107 |
| 2564 | GLU138-XAA139-XAA140-GLN141-XAA142-XAA143-LYS144 |
| 2565 | GLU138-GLN139-XAA140-GLN141 |
| 2566 | ARG175-XAA176-TYR177-XAA178-XAA179-ARG180 |
| 2567 | TYR177-XAA179-XAA180-LYS181 |

SEQUENCE LISTING (2567 sequences)

SEQ ID NO: 1 - protein, 124 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGSLSRSGWYAGLFDYWGQGTLVTVSS

SEQ ID NO: 2 - protein, 124 aa, Artificial Sequence
  chemically synthesized
QITLKESGGGVVQPGRSLRLSCAASGFTFSSYSMNWVRQAPGKGLQWVAIISDDGSKSYYADSVQGRFTISRDNSRNTVFLQMNSLRAEDTAMYYCARDRGTKWNQLNDVFDMWGQGTMVTVSS

SEQ ID NO: 3 - protein, 123 aa, Artificial Sequence
  chemically synthesized
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGRGYSSSRLYYFDYWGQGTLVTVSS

SEQ ID NO: 4 - protein, 120 aa, Artificial Sequence
  chemically synthesized
QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSS

SEQ ID NO: 5 - protein, 119 aa, Artificial Sequence
  chemically synthesized
EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSS

SEQ ID NO: 6 - protein, 116 aa, Artificial Sequence
  chemically synthesized
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEYFYWGQGTLVTVSS

SEQ ID NO: 7 - protein, 123 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVNPGSYTREVSNFDYWGQGTLVTVSS

SEQ ID NO: 8 - protein, 121 aa, Artificial Sequence
  chemically synthesized
QVQLQQSGPELVKPSQTLTLTCGISGDSVSSNSVTWNWVRQSPSRGLEWLGRTYYRSQWYYNYAVSVKSRITISPDTSKNQFSLQLNSVTPEDTAVYYCATRGHNYGVDYWGPGTTVTVSS

SEQ ID NO: 9 - protein, 120 aa, Artificial Sequence
  chemically synthesized
QVQLVQSGGGLVKPGGSLRLSCAASGFTFSNAWMSWVRQAPGKGLEWVCRIKSKTDGETTDYAAPVKGRFTISRDDSKNTLYLQMNSLKTEDTAVYHCTTGVGWSPFQYWGQGTLVTVSS

SEQ ID NO: 10 - protein, 127 aa, Artificial Sequence
  chemically synthesized
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRDDKIAAAGFTYWYFDLWGRGTLVTVSS

SEQ ID NO: 11 - protein, 118 aa, Artificial Sequence
  chemically synthesized
QVQLVQSGAEVKKPGASVKVSCKASGYTFAAYYLHWVRQAPGQGLEWMGRISPGNGVTSYAQKFQGRVTMTGDTSINTVYMQLNNLISGDTAVYYCAREAADDPFDHWGQGALVTVSS

SEQ ID NO: 12 - protein, 115 aa, Artificial Sequence
  chemically synthesized
EVQLVQSGGGVVQPGRSLTLSCAASGFTFSSHLMHWVRQAPGKGLEWVAVISYDGTSKYYGDSVKGRFTISRDNSKNTLYLQMNSLRAEDTAIYYCAKADYKYDWGQGTLVTVSS

SEQ ID NO: 13 - protein, 125 aa, Artificial Sequence
  chemically synthesized
EVQLVQSGGGLVKPGGSLRLSCTASGFTFGDYAMSWVRQAPGKGLEWVGFIRSKAYGGTTEYAASVKGRFTISRDDSKSIAYLQMNSLKTEDTAVYYCTTHRRPIYDILTGFDYWGQGTLVTVSS

SEQ ID NO: 14 - protein, 121 aa, Artificial Sequence
  chemically synthesized
QLQLQESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTREDTMVRGVIPWGQGTLVTVSS

SEQ ID NO: 15 - protein, 128 aa, Artificial Sequence
  chemically synthesized
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARDRRYYDSSGYYPAYYFDYWGQGTLVTVSS

SEQ ID NO: 16 - protein, 122 aa, Artificial Sequence
  chemically synthesized
EVQLVQSGGGLVKPGGSLRLSCAASGFTFSSYSMNWVRQAPGKGLEWVSYISSSGSYTNYADSVKGRFTISRDNAKNSLYLQINSLRAEDTAIYYCARDGGYDSSGFHFDYWGQGTLVTVSS

SEQ ID NO: 17 - protein, 129 aa, Artificial Sequence
  chemically synthesized
QVQLQQSGPGLVKPSQTLSLTCAISGDSVSNNRAAWNWIRQSPSRGLEWLGRTYYRSKWYNEYAVSVKSRITINPDTSKNQFSLQLNSMTPEDSAVYYCAILPSSGYLQDHHYYGMDVWGQGTTVTVSS

SEQ ID NO: 18 - protein, 122 aa, Artificial Sequence
  chemically synthesized
EVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARAAVGDGYSYGRLDWGQGTLVTVSS

SEQ ID NO: 19 - protein, 127 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPSYYYDSSGYFTWYFDLWGRGTLVTVSS

SEQ ID NO: 20 - protein, 122 aa, Artificial Sequence
  chemically synthesized
EVQLVQSGAEVKKPGASVKVSCKASGYTFTSYGISWVRQAPGQGLEWMGWIIPIFGIANYAQKFQGRVTITADKSTSTAYMELSSLRSEDTAVYYCARELYNYGSKDYFDYWGQGTLVTVSS

SEQ ID NO: 21 - protein, 123 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGTWDTAMVTGFDYWGQGTLVTVSS

SEQ ID NO: 22 - protein, 124 aa, Artificial Sequence
  chemically synthesized
EVQLVQSGAEVKKPGESLKISCKGSGYSFTSYWIAWVRQMPGKGLEWMGVIYPGDSDTRYSPSFQGQVTISADKSINTAYLQWSSLKASDTAMYYCARPHYDILTGSRAPFDYWGQGTLVTVSS

SEQ ID NO: 23 - protein, 120 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSS

SEQ ID NO: 24 - protein, 123 aa, Artificial Sequence
  chemically synthesized
EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSS

SEQ ID NO: 25 - protein, 117 aa, Artificial Sequence
  chemically synthesized
QITLKESGGGLVQPGGSLRLSCTVSGFTFSNNWMTWVRQTPGKGLEWVANIKQDGTEKHYVDSVKGRFTISRDNAENSLYLQMNSLRGEDTAVYYCARNSQRSFDYWGQGTLVTVSS

SEQ ID NO: 26 - protein, 121 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGDPRGGILNYWGQGTLVTVSS

SEQ ID NO: 27 - protein, 125 aa, Artificial Sequence
  chemically synthesized
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSPWGELSLYQGAFDIWGQGTMVTVSS

SEQ ID NO: 28 - protein, 121 aa, Artificial Sequence
  chemically synthesized
QITLKESGGGLVQPGRSLRLSCAASGFTFDDYAMHWVRQAPGKGLEWVSAISGSGGSTYYADSVKGRFTISRDNSKNTLYLQMNSLRAEDTAVYYCAKDNDFWSGKVFDYWGQGTLVTVSS

SEQ ID NO: 29 - protein, 121 aa, Artificial Sequence
  chemically synthesized
EVQLVQSGGGLVQPGGSLRLSCAASGFTFSSYSMNWVRQAPGKGLEWVSYISSTSSTIYYADSVKGRFTISRDNSKNMLFLQMNSLRAEDTAVYYCAKEGGSGWRHYFDYWGQGTLVTVSS

SEQ ID NO: 30 - protein, 123 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARDYCSSTSCQNWFDPWGQGTLVTVSS

SEQ ID NO: 31 - protein, 119 aa, Artificial Sequence
  chemically synthesized
QVQLVQSGGGLVQPGGSLRLSCAASGFTFSNYVMSWVRQAPGKGLEWVSAISGIGDTTYYADSVKGRFTISRDNAKNTLYLQMNSLRAEDTAVYYCARGRVAGDAFDIWGQGTMVTVSS

SEQ ID NO: 32 - protein, 123 aa, Artificial Sequence
  chemically synthesized
QLQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQGAAAGTLGYFDYWGQGTLVTVSS

SEQ ID NO: 33 - protein, 123 aa, Artificial Sequence
  chemically synthesized
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCTRGIYDSSGSSNPFDSWGQGTLVTVSS

SEQ ID NO: 34 - protein, 124 aa, Artificial Sequence
  chemically synthesized
EVQLVQSGAEVKKPGASVKISCEASGYTFTDYAIHWVRQAPGQRLEWMGWINAGDGGTKSSREFQGRVTITRDTSATTAYMEVSSLRSEDTAVYYCARGYCSGGSCPGTDFDYWGQGTLVTVSS

SEQ ID NO: 35 - protein, 122 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGVGGRDGYNFDYWGQGTLVTVSS

SEQ ID NO: 36 - protein, 119 aa, Artificial Sequence
  chemically synthesized
EVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARAPLAADGYFDYWGQGTLVTVSS

SEQ ID NO: 37 - protein, 122 aa, Artificial Sequence
  chemically synthesized
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARARGLQYLIWYFDLWGRGTLVTVSS

SEQ ID NO: 38 - protein, 123 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCASPGMVRGVITAPLDYWGQGTLVTVSS

SEQ ID NO: 39 - protein, 120 aa, Artificial Sequence
  chemically synthesized
EVQLVQSGGGLVKPGGSLRLSCAASGFTFSSYAISWVRQAPGQGLEWMGGIIPMYGTANYAQKFQGRVTITADESTSTAYMELSSLRSEDTALYYCAREAKWGMYYFDYWGQGTLVTVSS

SEQ ID NO: 40 - protein, 124 aa, Artificial Sequence
  chemically synthesized
EVQLVESGGGVVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSS

SEQ ID NO: 41 - protein, 118 aa, Artificial Sequence
  chemically synthesized
QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSS

SEQ ID NO: 42 - protein, 126 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSS

SEQ ID NO: 43 - protein, 123 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGTMVRGFGFNYWGQGTLVTVSS

SEQ ID NO: 44 - protein, 126 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAMIGPLPRLVGYFDLWGRGTLVTVSS

SEQ ID NO: 45 - protein, 124 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPAPSWVKTRNWFDPWGQGTLVTVSS

SEQ ID NO: 46 - protein, 119 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREASSGWNWGQGTLVTVSS

SEQ ID NO: 47 - protein, 124 aa, Artificial Sequence
  chemically synthesized
QVQLQESGPGLVKPSQTLSLTCAISGDSVSSNNAAWNWIRQSPSRGLEWLGRTFYRSKWYNDYAVSVKSRLTVNPDTSKNQFSLRLNSVSPEDTAVYYCARGGRYTKGGYFDDWGQGTLVTVSS

SEQ ID NO: 48 - protein, 123 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRLDSSGRGGYFDYWGQGTLVTVSS

SEQ ID NO: 49 - protein, 127 aa, Artificial Sequence
  chemically synthesized
EVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKELVGTSSPYYYYYYGMDVWGQGTMVTVSS

SEQ ID NO: 50 - protein, 118 aa, Artificial Sequence
  chemically synthesized
QLQLQESGGGLVQPGGSLRLSCAASGFTVSSNYMSWVRQAPGKGLEWVSVIYSGGSTYYADSVKGRFTISRDNSKNTLYLQMNSLRAEDTAVYYCARDYYYGSGSSPWGQGTLVTVSS

SEQ ID NO: 51 - protein, 125 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPYCSSTSCYPEWFDPWGQGTLVTVSS

SEQ ID NO: 52 - protein, 127 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKLRGIDYYDSSGYQRGFDYWGQGTLVTVSS

SEQ ID NO: 53 - protein, 119 aa, Artificial Sequence
  chemically synthesized
QVQLQESGPGLVKPSETLSLTCTVSGGSISSYYWSWIRQPPGKGLEWIGYIYYTGSTNYNPSLKSRVTISVDTSKNQFSLKLSSVTTADTAVYYCARGGRGDGAAFDIWGQGTMVTVSS

SEQ ID NO: 54 - protein, 123 aa, Artificial Sequence
  chemically synthesized
QVQLVQSGGGVVQPGRSLRLSCAASGFTFSSSAMHWVRQAPGKGLEWVAMIWHDESKKYYADSVKGRFTISRDNSKNTLYLQMNSLRAEDTAVYYCARPPDGGNSGRWYFDLWGRGTLVTVSS

SEQ ID NO: 55 - protein, 129 aa, Artificial Sequence
  chemically synthesized
QMQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDKNVRKHDYGDHPYGGYFDYWGQGTLVTVSS

SEQ ID NO: 56 - protein, 118 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVAGATSLWYWGQGTLVTVSS

SEQ ID NO: 57 - protein, 121 aa, Artificial Sequence
  chemically synthesized
QVQLQQSGPGLVKPSQSLSLTCAISGDSVSSNSAAWNWIRQSPSRGLEWLGRTYYRSKWYNDYAVSVKSRITIKPDTSKNQFSLQLNSVTPEDTAVYYCTRLANSDGVDVWGQGTMVTVSS

SEQ ID NO: 58 - protein, 120 aa, Artificial Sequence
  chemically synthesized
QVQLQQSGPGLVKPSQTLSLTCAISGDSVSSDSAVWTWIRQSPSRGLEWLGRTYYKSKWYNDYAASVKSRITINPDTSKNQFSLHLNSVTPEDTAVYYCARGVTRTFDYWGQGTTVTVSS

SEQ ID NO: 59 - protein, 119 aa, Artificial Sequence
  chemically synthesized
QLQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAEGNGPFDPWGQGTLVTVSS

SEQ ID NO: 60 - protein, 120 aa, Artificial Sequence
  chemically synthesized
QITLKESGGGVVQPGRSLRLSCVASGFTFSTYPMHWVRQAPGKGLEWVAVISYDGRNEYYADSVKGRFTISRDNSKNTLYLQMNSLRAEDTAVYYCATRDTPLVGVSIYWGQGTLVTVSS

SEQ ID NO: 61 - protein, 121 aa, Artificial Sequence
  chemically synthesized
QMQLVQSGGGLVKAGGSLRLSCSASGFTFSSYAMHWVRQAPGKGLEYVSAISSNGGSTYYADSVKGRFTISRDNSKNTLYLQMSSLRAEDTAVYYCVNRAGYGDYRHFQHWGQGTLVTVSS

SEQ ID NO: 62 - protein, 119 aa, Artificial Sequence
  chemically synthesized
EVQLVQSGGGVVQPGGSLRLSCAASGFTFSSYGMHWVRQAPGKGLEWVAFISYDGSNKYYADSVKGRFTISRDNSKNTLYLQMNSLRAEDTAVYYCATTGDRFQEFDYWGQGTLVTVSS

SEQ ID NO: 63 - protein, 122 aa, Artificial Sequence
  chemically synthesized
QMQLVQSGGVLLQPGRSLRLSCTASGFTFAAYNINWFRQGPGGGLEWVGFIRANADSGTTEYAASVKGRFFISRDDSRSTAYLQMTSLKTEDTAVYYCARDDRGRGDDFDYWGQGTLVTVSS

SEQ ID NO: 64 - protein, 121 aa, Artificial Sequence
  chemically synthesized
QVQLVQSGGGLVQPGGSLRLSCAASGFTFSSYGMTWVRQAPGKGLEWVSTISGNGVGTYYPDSVKDRFTISRDSSKNTVYLQMNSLRAEDTAVYYCVKHGRAGINWYFDLWGRGTLVTVSS

SEQ ID NO: 65 - protein, 121 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGGLWAFDIWGQGTTVTVSS

SEQ ID NO: 66 - protein, 117 aa, Artificial Sequence
  chemically synthesized
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKIGSCPYWGQGTLVTVSS

SEQ ID NO: 67 - protein, 121 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPDSSSQCFDYWGQGTLVTVSS

SEQ ID NO: 68 - protein, 119 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSS

SEQ ID NO: 69 - protein, 122 aa, Artificial Sequence
  chemically synthesized
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDVNPELLGAGFDYWGQGTLVTVSS

SEQ ID NO: 70 - protein, 123 aa, Artificial Sequence
  chemically synthesized
QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSS

SEQ ID NO: 71 - protein, 123 aa, Artificial Sequence
  chemically synthesized
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVKAPRGVVPAAMRGGYWGQGTLVTVSS

SEQ ID NO: 72 - protein, 124 aa, Artificial Sequence
  chemically synthesized
QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSS

SEQ ID NO: 73 - protein, 129 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRSLPYRGLAPRSFGGYYFDYWGQGTLVTVSS

SEQ ID NO: 74 - protein, 121 aa, Artificial Sequence
  chemically synthesized
QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSS

SEQ ID NO: 75 - protein, 124 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGMYYYGSGSSYFDYWGQGTLVTVSS

SEQ ID NO: 76 - protein, 121 aa, Artificial Sequence
  chemically synthesized
QVQLVQSGGGLVQPGGSLRLSCAASGFTFSSYAMSWVRQAPGKGLEWVSGISGSGGSTYYADSVKGRFTISRDNSKNMLFLQMNSPRAEDTAVYYCAKKIAAAGKQPVDYWGQGTLVTVSS

SEQ ID NO: 77 - protein, 131 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRKVYDYVWGSYRLPGSVSYYFDYWGQGTLVTVSS

SEQ ID NO: 78 - protein, 119 aa, Artificial Sequence
  chemically synthesized
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPGRAARPDYWGQGTLVTVSS

SEQ ID NO: 79 - protein, 125 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGAVAGTKPKYYFDYWGQGTLVTVSS

SEQ ID NO: 80 - protein, 123 aa, Artificial Sequence
  chemically synthesized
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARATYYYDSSGYRFDYWGQGTLVTVSS

SEQ ID NO: 81 - protein, 116 aa, Artificial Sequence
  chemically synthesized
EVQLVQSGGGLVEPGGSLRLSCAASRFTFSDAWMSWVRQAPGKGLEWVGRIKSKISGGTTDYAAPVQGRFTISRDDSKNTLYLQMDSLKTEDTAVYYCANRNLGYWGQGTLVTVSS

SEQ ID NO: 82 - protein, 127 aa, Artificial Sequence
  chemically synthesized
EVQLVQSGAEVKKPGASVKVSCKASGYTFTSYAMHWVRQAPGQRLEWMGWINAGNGNTKYSQKFQGRVTMTTDTSTSTAYMELRSLRSDDTAVYYCARARYYDSSGYIAPSGYFDYWGQGTLVTVSS

SEQ ID NO: 83 - protein, 122 aa, Artificial Sequence
  chemically synthesized
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGPAVDGAEYFQHWGQGTLVTVSS

SEQ ID NO: 84 - protein, 123 aa, Artificial Sequence
  chemically synthesized
QLQLQESGPGLVKPSQTLSLTCAISGDSVSSNSAAWNWIRQSPSRGLEWLGRTYYRSKWYNDYAVSLKSRITINPDTSKNQFSLQLNSVTPEDTAVYYCASLASGSPPPGDYWGQGTLVTVSS

SEQ ID NO: 85 - protein, 119 aa, Artificial Sequence
  chemically synthesized
QVTLKESGGGVVQPGRSLRLSCAASGFTFSTYGMHWVRQAPGKGLEWVALISYDGSKKYYANSVKGRFTISRDNSKNTLYLQMKSLRAEDTAMYYCAKGPIVGATMDYWGQGALVTVSS

SEQ ID NO: 86 - protein, 118 aa, Artificial Sequence
  chemically synthesized
EVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARWYGDYGLDYWGQGTLVTVSS

SEQ ID NO: 87 - protein, 128 aa, Artificial Sequence
  chemically synthesized
EVQLVQSGAEVKKPGASVKVSCKASGYTFTSYAMHWVRQAPGQRLAWMGWINAGNGNTKYSEKFEGRVTITRDTSASTAYMELSSLRSEDTAVYYCARVAKYYYESGGYRASNWFDPWGQGTLVTVSS

SEQ ID NO: 88 - protein, 127 aa, Artificial Sequence
  chemically synthesized
QVQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAPPPTVGWYAPVFDYWGQGTLVTVSS

SEQ ID NO: 89 - protein, 120 aa, Artificial Sequence
  chemically synthesized
QLQLQESGGGLVQPGGSLRLSCSASGISFRDYWMHWIRQTPGKGLVWVSRINPDGSSTSYADSVKGRFTISRDNSKNTLYLQMNSLRAEDTAVYYCAKVTGRRVGAHDYWGQGTLVTVSS

SEQ ID NO: 90 - protein, 121 aa, Artificial Sequence
  chemically synthesized
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAFAQPGAETLNFDLWGRGTLVTVSS

SEQ ID NO: 91 - protein, 120 aa, Artificial Sequence
  chemically synthesized
QVQLQQSGPGLVKPSQTLSLTCAISGDSVSSKSAAWNWIRQSPSRGLEWLGRTYYRSKWNNDYALSVKSRITINPDTSKNQFSLQLKSVTPEDTALYYCVRQVAGGMDVWGQGTTVTVSS

SEQ ID NO: 92 - protein, 123 aa, Artificial Sequence
  chemically synthesized
QVQLVQSGGGLVQPGRSLRLSCTASGFTFGDYAMSWFRQAPGKGLEWVSAISGSGGSTYYADSVKGRFTISRDNSKNTLYLQMNSLRAEDTAVYYCAKGSVYSGSYYMLIDYWGQGTLVTVSS

SEQ ID NO: 93 - protein, 125 aa, Artificial Sequence
  chemically synthesized
QVQLQQSGPGLVRPSQTLSLTCVISGDSVSSGSAAWNWIRQSPSRGLEWLGRTYYRAKWYNEYAGSVKSRITISPDTSKNQFSLQLNSVTPEDTAVYFCTRQDKDNTRYSGLGVWGQGTTVTVSS

SEQ ID NO: 94 - protein, 123 aa, Artificial Sequence
  chemically synthesized
EVQLVETGGGLVQPGGSLRLSCAASEFTLRNYGVSWVRQAPGKGLEWVSGMSGSGYSTYYADSVKGRFTISRDSSKNTLFLQMDSLRAEDTAIYYCARGPRMWSSGIDAFDIWGHGTMVTVSS

SEQ ID NO: 95 - protein, 116 aa, Artificial Sequence
  chemically synthesized
QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSS

SEQ ID NO: 96 - protein, 122 aa, Artificial Sequence
  chemically synthesized
QVQLQQSGPGLLKPSQTLSLTCAISGDSVSSNTATWNWIRQSPSRGLEWLGRTYYRSKWYKDNALSVKSRITINPDTSKNQFSLQLNSVTPEDTAVYYCAGGRAGIAAFDIWGQGTTVTVSS

SEQ ID NO: 97 - protein, 120 aa, Artificial Sequence
  chemically synthesized
QVQLVQSGGGLIQPGGSLRLSCAASGFTVSSNYMSWVRQAPGKGLEWVSLIYSDGRTNYADSVKGRFTISRDNSKNTLYLQMNSLRAEDTAVYYCAKGALQGEWRRFDYWGQGTLVTVSS

SEQ ID NO: 98 - protein, 126 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCTRTNQGYGGNSGVFDYWGQGTLVTVSS

SEQ ID NO: 99 - protein, 120 aa, Artificial Sequence
  chemically synthesized
QVQLQQSGPGLVKPSQTLSLTCAISGDSVSGNSAAWNWIRQSPSRGLEWLGRTYYRSKWYNDYAVSVKSRITINPDTSKNQFSLQLNSVTPEDTAVYYCARIVGGAVDCWGQGTLVTVSS

SEQ ID NO: 100 - protein, 124 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVRVGATTVYDSWFDPWGQGTLVTVSS

SEQ ID NO: 101 - protein, 129 aa, Artificial Sequence
  chemically synthesized
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGGSSPYYDSSGLLPWYFDLWGRGTLVTVSS

SEQ ID NO: 102 - protein, 119 aa, Artificial Sequence
  chemically synthesized
QVQLQESGGGLVQPGGSLRLSCAASGFTFSSYAMHWVRQAPGKGLEYVSAISSNGGSTYYANSVKGRFTISRDNSKNTLYLQMGSLRAEDMAVYYCARAKFWTYYFDYWGQGTLVTVSS

SEQ ID NO: 103 - protein, 122 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGGSGSYYKRFFDYWGQGTLVTVSS

SEQ ID NO: 104 - protein, 127 aa, Artificial Sequence
  chemically synthesized
EVQLVQSGAEVRKPGASVKVSCKASGYTFTSYAISWVRQAPGQGLEWMGWISAYDGNTNYAQKLQGRVTMTTDTSTSTAYMEVRSLRSDDTAVYYCARDGTVRRVVGATTPGNFDYRGQGTLVTVSS

SEQ ID NO: 105 - protein, 124 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDLNRGYCSGGSCFGYWGQGTLVTVSS

SEQ ID NO: 106 - protein, 120 aa, Artificial Sequence
  chemically synthesized
QVQLQESGGGLVQPGGSLRLSCAASGFTFSSYAMSWVRQAPGKGLEWVSYISSSGTTIYYADSVKGRFTVSRDNAKNSLYLQMNSLRAEDTAVYYCARDYSSSGECFDYWGQGTLVTVSS

SEQ ID NO: 107 - protein, 120 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDQAAMVGYFDYWGQGTLVTVSS

SEQ ID NO: 108 - protein, 123 aa, Artificial Sequence
  chemically synthesized
QVTLKESGGGVVQPGRSLRLSCAASGFIFSNYAIHWVRQAPGKGLEWVAVISYDGSNKYYADSVKGRFTISRDNSKNTLYLQMNSLRAEDTAVYYCARTFAGYSSKLGYFDLWGRGTLVTVSS

SEQ ID NO: 109 - DNA, 372 bp, Artificial Sequence
  chemically synthesized
gaagtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggctccttgtcccgaagtggctggtacgccggactctttgactactggggccagggaaccctggtcaccgtctcctca

SEQ ID NO: 110 - DNA, 372 bp, Artificial Sequence
  chemically synthesized
cagatcaccttgaaggagtctgggggaggcgtggtccagcctgggaggtccctgagactctcctgtgcagcctctggattcaccttcagtagttatagcatgaactgggtccgccaggctccaggcaaggggctgcagtgggtggcaattatatcagatgatggaagtaagagttactacgcagactccgtgcagggccgattcaccatctccagagacaattcgaggaacacagtatttctgcaaatgaacagcctgagagctgaggacacggctatgtattactgtgcgagagacaggggaactaaatggaaccaattgaatgatgtttttgatatgtggggccaagggacaatggtcaccgtctcttca

SEQ ID NO: 111 - DNA, 369 bp, Artificial Sequence
  chemically synthesized
gaagtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggccgagggtatagcagcagtcggctctactactttgactactggggccagggaaccctggtcaccgtctcctca

SEQ ID NO: 112 - DNA, 360 bp, Artificial Sequence
  chemically synthesized
caggtcaccttgaaggagtctgggggaggcttggtccggcctggagggtccctgagactctcctgtgaagcctctggattcaccttcagtgacccctacatggactgggtccgccaggctccaggcaaggggctggagtgggttggccgaattacaaataagcgtaccggttacgccacaacatatgccgcgtctgtgaaggacagattcaccatctcaagagatgattcaaggaagtcagtatatctgcaaatgaacagcctgaagaccgaggacacggccgtatattattgtgcaacagatgtcagtgggtccttcgcggcctacgggggccagggcaccctggtcaccgtctcctca

SEQ ID NO: 113 - DNA, 357 bp, Artificial Sequence
  chemically synthesized
gaggtccagctggtacagtctgggggaggcgtggtccagcctgggaggtccctgagactctcctgtgcagcgtctggattcaccttcagtagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgggagagggcggagcagtggctggtactgtctactggggccagggaaccctggtcaccgtctcctca

SEQ ID NO: 114 - DNA, 348 bp, Artificial Sequence
  chemically synthesized
caggtccagctggtgcagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacgagtatttctactggggccagggaaccctggtcaccgtctcctca

SEQ ID NO: 115 - DNA, 369 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagtaaatccggggagttatacgagggaggtgagcaactttgactactggggccagggaaccctggtgaccgtctcctca

SEQ ID NO: 116 - DNA, 363 bp, Artificial Sequence
  chemically synthesized
caggtacagctgcagcagtcaggtccagaattggtgaagccctcgcagaccctcacactcacctgtggcatctccggggacagtgtctctagcaacagtgttacttggaactgggtcaggcagtccccatcgagaggccttgagtggctgggaaggacttactaccggtcccagtggtattataattatgcggtgtctgtgaaaagtcgaataaccatcagcccagacacatccaagaaccagttctccctgcagttgaattctgtgactcccgaggacacggctgtctattactgtgcaaccaggggacataactacggtgtagattactggggcccggggaccacggtcaccgtctcctca

SEQ ID NO: 117 - DNA, 360 bp, Artificial Sequence
  chemically synthesized
caggtgcagctggtgcagtctgggggaggcttggtaaagcctggggggtcccttagactctcctgtgcagcctctggattcactttcagtaacgcctggatgagctgggtccgccaggctccagggaaggggctggagtgggtttgccgtattaaaagcaaaactgatggtgagacaacagactacgctgcacccgtgaaaggcagattcaccatctcaagagatgattcaaaaaacacgctgtatctgcaaatgaacagcctgaaaactgaggacacagccgtgtatcactgtaccacaggggtgggatggtcgcccttccaatactggggccagggcaccctggtcaccgtctcctca

SEQ ID NO: 118 - DNA, 381 bp, Artificial Sequence
  chemically synthesized
gaggtccagctggtacagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacgacaaaatagcagcagctggattcacatactggtacttcgatctctggggccgtggcaccctggtcaccgtctcctca

SEQ ID NO: 119 - DNA, 354 bp, Artificial Sequence
  chemically synthesized
caggtgcagctggtgcagtctggggctgaggtgaagaagcctggggcctcagtgaaggtctcctgcaaggcttctggatacaccttcgccgcctattatttacactgggtgcgacaggcccctggacaaggccttgagtggatggggcggatcagccctggtaacggtgtcacaagttatgcacagaaatttcagggcagagtcaccatgaccggggacacgtccattaacacagtctacatgcaactgaacaatttgatttctggcgacacggccgtatattactgtgcgagagaggctgccgacgacccgtttgaccattggggccagggagccctggtcaccgtctcctca

SEQ ID NO: 120 - DNA, 345 bp, Artificial Sequence
  chemically synthesized
gaagtgcagctggtgcagtctgggggaggcgtggtccagcctgggaggtccctgacactctcctgtgcagcctctggattcaccttcagttcccatcttatgcactgggtccgccaggctccaggcaaggggctggagtgggtggcagttatatcatatgatggaactagtaaatattacggagactccgtgaagggccgcttcaccatctccagagacaattccaagaacacgttgtatctgcaaatgaacagcctgcgagctgaagacacggctatatattactgtgcgaaagcagattataaatatgactggggccagggaaccctggtcaccgtctcctca

SEQ ID NO: 121 - DNA, 375 bp, Artificial Sequence
  chemically synthesized
gaggtgcagctggtgcagtctgggggaggcttggtcaagcctggagggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactactcatagacgcccaatttacgatattttgactggttttgactactggggccagggaaccctggtcaccgtctcctca

SEQ ID NO: 122 - DNA, 363 bp, Artificial Sequence
  chemically synthesized
cagctgcagctgcaggagtccgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggatactatggttcggggagttattccctggggccagggaaccctggtcaccgtctcctca

SEQ ID NO: 123 - DNA, 384 bp, Artificial Sequence
  chemically synthesized
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggctgtgtattactgtgcgagagatcggcgttactatgatagtagtggttattatcccgcctactactttgactactggggccagggaaccctggtcaccgtctcctca

SEQ ID NO: 124 - DNA, 366 bp, Artificial Sequence
  chemically synthesized
gaagtgcagctggtgcagtctgggggaggcctggtcaagcctggggggtccctgagactctcctgtgcagcctctggattcaccttcagtagctatagcatgaactgggtccgccaggctccagggaaggggctggagtgggtttcatacattagtagtagtggtagttacacaaactacgcagactctgtgaagggccgattcaccatctccagagacaacgccaagaactcactgtatctgcaaataaacagcctgagagccgaggacacggccatttattactgtgcgagagacgggggctatgatagtagtggttttcactttgactactggggccagggaaccctggtcaccgtctcctca

SEQ ID NO: 125 - DNA, 387 bp, Artificial Sequence
  chemically synthesized
caggtacagctgcagcagtcaggtccaggactggtgaagccctcgcagaccctctcactcacctgtgccatctccggggacagtgtctctaacaacagggctgcttggaactggatcaggcagtcgccatcgagaggccttgagtggctgggaaggacatactacaggtccaagtggtataatgaatatgcagtctctgtgaaaagtcgaataaccatcaacccagacacatccaagaaccagttctccctgcagctgaactctatgactcccgaggactcggctgtgtattactgtgcaattttgcctagtagtggttatctacaggaccaccactactacggtatggacgtctggggccaagggaccacggtcaccgtctcctca

SEQ ID NO: 126 - DNA, 366 bp, Artificial Sequence
  chemically synthesized
gaggtgcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacacggccgtgtattactgtgcgagagccgcggtgggggatggatacagctatggtcggctcgattggggccagggaaccctggtcaccgtctcctca

SEQ ID NO: 127 - DNA, 381 bp, Artificial Sequence
  chemically synthesized
gaggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccctcgtattactatgatagtagtggttactttacctggtacttcgatctctggggccgtggcaccctggtgaccgtctcttca

SEQ ID NO: 128 - DNA, 366 bp, Artificial Sequence
  chemically synthesized
gaggtccagctggtacagtctggagctgaggtgaagaagcctggggcctcagtgaaggtctcctgcaaggcttctggttacacctttaccagctatggtatcagctgggtgcgacaggcccctggacaagggcttgagtggatgggatggatcatccctatctttggtatagcaaactacgcacagaagttccagggcagagtcacgattaccgcggacaaatccacgagcacagcctacatggagctgagcagcctgagatctgaggacacggccgtgtattactgtgcgagagaactatacaactatggttcaaaggactactttgactactggggccagggaaccctggtcaccgtctcctca

SEQ ID NO: 129 - DNA, 369 bp, Artificial Sequence
  chemically synthesized
gaagtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcggtacttgggatacagctatggttacgggctttgactactggggccagggaaccctggtcaccgtctcctca

SEQ ID NO: 130 - DNA, 372 bp, Artificial Sequence
  chemically synthesized
gaagtgcagctggtgcagtctggagcagaggtgaaaaagcccggggagtctctgaagatctcctgtaagggttctggatacagctttaccagctactggatcgcctgggtgcgccagatgcccgggaaaggcctggagtggatgggggtcatctatcctggtgactctgataccagatacagcccgtccttccaaggccaggtcaccatctcagccgacaagtccatcaataccgcctacctgcagtggagcagcctgaaggcctcggacaccgccatgtattactgtgcgagaccccattacgatattttgactggttcccgggcgccctttgactactggggccagggaaccctggtcaccgtctcctca

SEQ ID NO: 131 - DNA, 360 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccgagtggaatccaaggatgggtactttgactactggggccagggaaccctggtcaccgtctcctca

SEQ ID NO: 132 - DNA, 369 bp, Artificial Sequence
  chemically synthesized
gaggtgcagctggtggagtctgggggaggcgtggtccagcctgggaggtccctgagactctcctgtgcagcctctggattcactttcactgatgcctggatgaactgggtccgccaggctccagggaaggggctggagtggattggccgtgttaaaaacaaagctgatggtgagacaacggactacgctgcacccgtcaaaggcagaatcaccatctcaagagatgatgcaaagaacactctgtatgtgcaaatgaacagcctgaaaaccgaggacacagccgtgtattattgtaccgctgacctgcgactttctacgtgggatgcttatgatttctggggccaagggacaatggtcaccgtctcttca

SEQ ID NO: 133 - DNA, 351 bp, Artificial Sequence
  chemically synthesized
cagatcaccttgaaggagtctgggggaggcttggtccagcctggggggtccctaagactctcttgtacagtctcaggattcacctttagtaacaattggatgacctgggtccgccagactccagggaaggggctggagtgggtggccaacataaagcaagatggaactgagaaacactatgtggactctgtgaagggccgattcaccatctccagagacaacgccgagaactcactgtatctgcagatgaacagcctgagaggtgaggacacggccgtgtattattgtgcgagaaacagtcaacgttcgtttgactactggggccagggcaccctggtgaccgtctcctca

SEQ ID NO: 134 - DNA, 363 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttaggggatccccggggtggtattttgaactactggggccagggcaccctggtcaccgtctcctca

SEQ ID NO: 135 - DNA, 375 bp, Artificial Sequence
  chemically synthesized
gaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcccggtcgagcccctggggggagttatcgttataccagggggcttttgatatctggggccaagggacaatggtcaccgtctcttca

SEQ ID NO: 136 - DNA, 363 bp, Artificial Sequence
  chemically synthesized
cagatcaccttgaaggagtctgggggaggcttggtacagcctggcaggtccctgagactctcctgtgcagcctctggattcacctttgatgattatgccatgcactgggtccggcaagctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataacgatttttggagtgggaaagtctttgactactggggccagggcaccctggtcaccgtctcctca

SEQ ID NO: 137 - DNA, 363 bp, Artificial Sequence
  chemically synthesized
gaagtgcagctggtgcagtctgggggaggcttggtacagcctggggggtccctgagactctcctgtgcagcctctggattcaccttcagtagttatagcatgaactgggtccgccaggctccagggaaggggctggagtgggtttcatacatcagtagtactagtagtaccatatactacgcagactccgtgaagggccgattcaccatctccagagacaattccaagaatatgctgtttctacaaatgaacagcctgagagctgaggacacggctgtgtattactgtgcgaaagaagggggcagtggctggcgccactactttgactactggggccagggaaccctggtcaccgtctcctca

SEQ ID NO: 138 - DNA, 369 bp, Artificial Sequence
  chemically synthesized
caggtcaccttgaaggagtctgggggaggcgtggtccagcctgggaggtccctgagactgtcctgtgcagcctctggattcaccttcagcagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagattattgtagtagtaccagctgccagaactggttcgacccctggggccagggcaccctggtcaccgtctcctca

SEQ ID NO: 139 - DNA, 357 bp, Artificial Sequence
  chemically synthesized
caggtccagctggtgcagtctgggggaggcttggtacagcctggggggtccctgagactctcctgtgcagcctctggattcacctttagcaactatgtcatgagctgggtccgccaggctccagggaaggggctggagtgggtctcagctattagtggtattggtgatactacatactacgcggactccgtgaagggccgattcaccatctccagagacaacgccaagaacacgctgtatctgcaaatgaacagtctgagagccgaggacacggctgtgtattactgtgcaagagggcgcgtggcgggggatgcttttgatatctggggccaagggacaatggtgaccgtctcttca

SEQ ID NO: 140 - DNA, 369 bp, Artificial Sequence
  chemically synthesized
cagctgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcaaggggcagcagctggtaccctggggtactttgactactggggccagggaaccctggtgaccgtctcctca

SEQ ID NO: 141 - DNA, 369 bp, Artificial Sequence
  chemically synthesized
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtacgagaggaatctatgatagtagtggttcttccaatccctttgactcctggggccagggaaccctggtgaccgtctcctca

SEQ ID NO: 142 - DNA, 372 bp, Artificial Sequence
  chemically synthesized
gaggtgcagctggtgcagtctggggctgaggtgaagaagcctggggcctcagtgaagatttcctgcgaggcttctggatacaccttcactgattatgctatacattgggtgcgccaggcccccggacaaagacttgagtggatgggatggatcaacgctggcgatggtggcacaaaaagttcacgggagttccagggcagagtcaccattaccagggacacatccgcgaccacagcctacatggaggtgagcagtctgagatctgaagacacggctgtctattactgtgcgagaggatattgtagtggtggtagctgcccaggaacggattttgactactggggccagggaaccctggtcaccgtctcctca

SEQ ID NO: 143 - DNA, 366 bp, Artificial Sequence
  chemically synthesized
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatggtgtaggagggagagatggctacaattttgactactggggccagggaaccctggtcaccgtctcctca

SEQ ID NO: 144 - DNA, 357 bp, Artificial Sequence
  chemically synthesized
gaagtgcagctggtgcagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagcccccctagcagcagatggctactttgactactggggccagggaaccctggtcaccgtctcctca

SEQ ID NO: 145 - DNA, 366 bp, Artificial Sequence
  chemically synthesized
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagcccgggggctacagtacctaatctggtacttcgatctctggggccgtggcaccctggtgaccgtctcctca

SEQ ID NO: 146 - DNA, 369 bp, Artificial Sequence
  chemically synthesized
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagcccgggtatggttcggggagttattactgccccgcttgactactggggccagggcaccctggtcaccgtctcctca

SEQ ID NO: 147 - DNA, 360 bp, Artificial Sequence
  chemically synthesized
gaggtccagctggtacagtctgggggaggcctggtcaagcctggggggtccctgagactctcctgtgcagcctctggattcaccttcagcagctatgctatcagctgggtgcgacaggcccctggacaagggcttgagtggatgggagggatcatccctatgtatggtacagcaaactacgcacagaagttccagggcagagtcacgattaccgcggacgaatccacgagcacagcctacatggaactgagcagcctgagatctgaggacacggccctctattactgtgcgagagaagctaagtggggaatgtactactttgactactggggccagggcaccctggtcaccgtctcctca

SEQ ID NO: 148 - DNA, 372 bp, Artificial Sequence
  chemically synthesized
gaggtgcagctggtggagtccgggggaggcgtggtccagcctgggaggtccctgagactctcctgtgcagcctctggattcaccttcagtagctatgctatacactgggtccgccaggctccaggcaaggggctggagtgggtggcaattatatcagatgatggaagtaagagttactacgcagactccgtgcagggccgattcaccatctccagagacaattcgaggaacacagtatatctgcaaatgaacagcctgagagctgaggacacggctatgtattactgtgcgagagacaggggaactaaatggaaccaattgaatgatgtttttgatatgtggggccaagggacaatggtcaccgtctcttca

SEQ ID NO: 149 - DNA, 354 bp, Artificial Sequence
  chemically synthesized
cagatgcagctggtgcaatctggggctgaggtgaagaagcctggggcctcagtgaaggtctcctgcacggcttctggatacaccttcaccagttctgatatcaactgggtgcgacaggccactggacaagggcttgagtggatgggatggatgaaccctaacagtggtaacaccggctatgcagagaagttccagggcagggtcaccatgaccagcgactcctccataagcaccgcctacatggagttgagaagcctgaccactgaggacacggccgtatattactgtgcgagaggtgggggtgcgagctatactgactcctggggccagggcaccctggtcaccgtctcctca

SEQ ID NO: 150 - DNA, 378 bp, Artificial Sequence
  chemically synthesized
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtaccgctaaggggggctacgtcggatacagctatggaccttttgggggctactggggccagggaaccctggtcaccgtctcctca

SEQ ID NO: 151 - DNA, 369 bp, Artificial Sequence
  chemically synthesized
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggggggactatggttcggggtttcggatttaactactggggccagggaaccctggtcaccgtctcctca

SEQ ID NO: 152 - DNA, 378 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccggcgggctatgatagggccgcttccgcgacttgtcgggtacttcgatctctggggccgtggaaccctggtcaccgtctcctca

SEQ ID NO: 153 - DNA, 372 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccgccccgccccatcctgggttaaaacccgtaactggttcgacccctggggccagggaaccctggtcaccgtctcctca

SEQ ID NO: 154 - DNA, 357 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggctagcagtggctggaactggggccagggaaccctggtcaccgtctcctca

SEQ ID NO: 155 - DNA, 372 bp, Artificial Sequence
  chemically synthesized
caggtgcagctgcaggagtccggtccaggactggtgaagccctcgcagaccctctcactcacctgtgccatctccggggacagtgtctctagcaacaatgctgcttggaactggatcaggcagtccccatcgagaggccttgagtggctgggaaggacattctacaggtccaagtggtataatgactatgcagtttctgtgaaaagtcgactaaccgtcaacccagacacatccaagaaccagttctccctgcggttgaactctgtgagtcccgaggacacggctgtgtattactgtgcaagagggggaagatataccaagggagggtactttgacgactggggccagggaaccctggtgaccgtctcctca

SEQ ID NO: 156 - DNA, 369 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagattggatagcagtggccgtggtggttactttgactactggggccagggcaccctggtcaccgtctcctca

SEQ ID NO: 157 - DNA, 381 bp, Artificial Sequence
  chemically synthesized
gaggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagagttggtgggtaccagctctccttattactactactactacggtatggacgtctggggccaagggacaatggtcaccgtctcttca

SEQ ID NO: 158 - DNA, 354 bp, Artificial Sequence
  chemically synthesized
cagctgcagctgcaggagtcggggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagactattactatggttcggggagttctccctggggccagggaaccctggtcaccgtctcctca

SEQ ID NO: 159 - DNA, 375 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccggccatattgtagtagtaccagctgctacccagagtggttcgacccctggggccagggaaccctggtcaccgtctcctca

SEQ ID NO: 160 - DNA, 381 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaattaaggggtatagattactatgatagtagtggttaccaacgggggtttgactactggggccagggaaccctggtcaccgtctcctca

SEQ ID NO: 161 - DNA, 357 bp, Artificial Sequence
  chemically synthesized
caggtgcagctgcaggagtccggcccaggactggtgaagccttcggagaccctgtccctcacctgcactgtctctggtggctccatcagtagttactactggagctggatccggcagcccccagggaagggactggagtggattggctatatctattacactgggagcaccaactacaacccctccctcaagagccgagtcaccatatcagtagacacgtccaagaaccagttctccctgaagctgagctctgtgaccactgcggacacggccgtgtattactgtgcgagaggtgggaggggggatggggccgcttttgacatctggggccaagggacaatggtcaccgtctcttca

SEQ ID NO: 162 - DNA, 369 bp, Artificial Sequence
  chemically synthesized
caggtgcagctggtgcaatctgggggaggcgtggtccagcctgggaggtccctgagactctcctgtgcagcgtctggattcaccttcagcagctctgccatgcactgggtccgccaggctccaggcaagggactggagtgggtggcaatgatttggcatgatgagagtaagaaatactatgcagactccgtgaagggccgattcactatctccagagacaattccaagaacacgctgtatctgcaaatgaacagcctgagagctgaggacacggctgtgtattactgtgcgagaccccccgacggtggtaactccggtcgctggtacttcgatctctggggccgtggcaccctggtcaccgtctcctca

SEQ ID NO: 163 - DNA, 387 bp, Artificial Sequence
  chemically synthesized
cagatgcagctggtgcaatctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacaagaacgtccgaaaacatgactacggtgaccacccctacggggggtactttgactactggggccagggcaccctggtgaccgtctcctca

SEQ ID NO: 164 - DNA, 354 bp, Artificial Sequence
  chemically synthesized
gaggtccagctggtacagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagtggcgggagctacttccctatggtactggggccagggcaccctggtcaccgtctcctca

SEQ ID NO: 165 - DNA, 363 bp, Artificial Sequence
  chemically synthesized
caggtacagctgcagcagtcaggtccaggactggtgaagccctcgcagagcctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaagagtcgaataaccatcaaaccagacacatccaagaaccagttctccctgcagctgaactctgtgactcccgaggacacggctgtgtattactgtacaaggctagctaattccgacggtgtggacgtctggggccaagggacaatggtcaccgtctcctca

SEQ ID NO: 166 - DNA, 360 bp, Artificial Sequence
  chemically synthesized
caggtacagctgcagcagtcaggtccaggactggtgaagccctcgcagaccctctcactcacctgtgccatctccggggacagtgtctctagcgacagtgctgtttggacctggatcaggcagtccccatcgagaggccttgagtggctgggaaggacatactacaagtcgaagtggtataatgattatgcagcatctgtgaaaagtcgaataaccatcaacccagacacatccaagaaccagttctccctgcacctgaactctgtgactcccgaggacacggctgtgtattactgtgcaagaggtgtaacccggacctttgactactggggccaggggaccacggtcaccgtctcctca

SEQ ID NO: 167 - DNA, 357 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcagaaggcaatgggccgttcgacccctggggccagggaaccctggtgaccgtctcctca

SEQ ID NO: 168 - DNA, 360 bp, Artificial Sequence
  chemically synthesized
cagatcaccttgaaggagtctgggggaggcgtggtccagcctgggaggtccctgagactctcctgtgtagcctctggattcaccttcagtacctatcccatgcactgggtccgccaggctccaggcaaggggctggagtgggtggcagttatatcatatgatggacgtaatgaatactacgcagactccgtgaagggccgattcaccatctccagagacaattccaaaaacacgctgtatctgcaaatgaacagtctgcgagctgaagacacggctgtctattattgtgcgactcgggatacacctttggttggggtttcgatatactggggccagggcaccctggtcaccgtctcctca

SEQ ID NO: 169 - DNA, 363 bp, Artificial Sequence
  chemically synthesized
cagatgcagctggtgcaatctgggggaggcctggtcaaggctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaatcgggcgggttacggtgactacagacacttccagcactggggccagggcaccctggtcaccgtctcctca

SEQ ID NO: 170 - DNA, 357 bp, Artificial Sequence
  chemically synthesized
gaggtgcagctggtgcagtctgggggaggcgtggtccagcctggggggtccctgagactctcctgtgcagcgtctggattcaccttcagtagctatggcatgcactgggtccgccaggctccaggcaaggggctggagtgggtggcatttatatcatatgatggaagtaataaatactacgcagactccgtgaagggccgattcaccatctccagagacaattccaagaacacgctgtatctgcaaatgaacagcctgagagccgaggacacggccgtatattactgtgcgacaacaggggaccgcttccaagagtttgactactggggccagggaaccctggtcaccgtctcctca

SEQ ID NO: 171 - DNA, 366 bp, Artificial Sequence
  chemically synthesized
cagatgcagctggtgcagtctgggggagtcttgcttcagccagggcggtccctgagactctcctgtacagcttctggattcacctttgctgcttataatatcaactggttccgccagggtcctgggggggggctggagtgggtaggtttcattagagccaacgctgatagtgggacaacagagtacgccgcgtctgtgaaaggcagattcttcatctcaagagatgattccagaagcaccgcctacctgcaaatgactagccttaaaaccgaggacacagccgtttattactgtgccagagatgatcggggtcggggagatgactttgactactggggccagggcaccctggtcaccgtctcctca

SEQ ID NO: 172 - DNA, 363 bp, Artificial Sequence
  chemically synthesized
caggtgcagctggtgcaatctgggggaggcttggtacagcctggggggtccctgagactctcctgtgcagcctctggattcacctttagcagctatggcatgacgtgggtccgccaggctccagggaaggggctggagtgggtctcaactattagtggtaatggtgttggcacatactacccagactccgtgaaggaccggttcaccatctccagagacagttccaagaacacggtgtatctgcaaatgaacagcctgagagccgaggacacggccgtatattactgtgtgaaacatggtagggccggaataaactggtacttcgatctctggggccgtggcaccctggtgaccgtctcctca

SEQ ID NO: 173 - DNA, 363 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggggagggctttgggcttttgatatctggggccaagggaccacggtcaccgtctcctca

SEQ ID NO: 174 - DNA, 351 bp, Artificial Sequence
  chemically synthesized
gaggtccagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacaagatcggcagctgtccttactggggccagggaaccctggtcaccgtctcctca

SEQ ID NO: 175 - DNA, 363 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccggatagcagcagtcaatgttttgactactggggccagggaaccctggtcaccgtctcctca

SEQ ID NO: 176 - DNA, 357 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaagcagtggctggtcactgcctgaagactactggggccagggaaccctggtcaccgtctcctca

SEQ ID NO: 177 - DNA, 366 bp, Artificial Sequence
  chemically synthesized
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacggatgtgaacccggagctactgggggcgggatttgactactggggccagggcaccctggtcaccgtctcctca

SEQ ID NO: 178 - DNA, 369 bp, Artificial Sequence
  chemically synthesized
caggtcaccttgaaggagtctgggggaggcttggtccagcctggagggtccctgagactctcctgtgcagcctctggattcaccttcagtgaccagtacatggactgggtccgccaggctccagggaaggggctggagtgggttggccgtgttagaaacaaagctaacagttacaccacagaatacgccgcgtctgtgaaaggcagattcaccatctcaagagatgattcaaagaactcactgtatctgcaaatgaatagtctgaacaccgaggacacggccatgtatttctgtgctagtagtctcaatagtgggggctaccgatgcttccatcactggggccagggcaccctggtgaccgtctcctca

SEQ ID NO: 179 - DNA, 369 bp, Artificial Sequence
  chemically synthesized
caggtccagctggtgcagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaaagcgccgaggggtgtagtaccagctgctatgcgggggggctactggggccagggaaccctggtcaccgtctcctca

SEQ ID NO: 180 - DNA, 372 bp, Artificial Sequence
  chemically synthesized
caggtgcagctgcaggagtcggggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattggtgggcaatagtgggagctactatccgtttgggtactggggccagggaaccctggtgaccgtctcctca

SEQ ID NO: 181 - DNA, 387 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctcggtgaccgccgcggacacggctgtgtattactgtgcgagaggccggtcccttccctaccgggggttggctcctagatctttcggaggatactactttgactactggggccagggaaccctggtcaccgtctcctca

SEQ ID NO: 182 - DNA, 363 bp, Artificial Sequence
  chemically synthesized
caggtgcagctgcaggagtcggggggaggcttggtacggcctggagggtccctgagactctcctgtggagactctggattcaacttcagtggatatgaaatgaactgggtccgccaggctccagggaaggggctggagtgggtttcatacgtcagtactagtggtagtaccagatactacgcagactctgtgaagggccgatttaccatctccagagacaacgccaagaacaccctgtatttgcaaatgaacagtctgagagtcgaggacacggctgtgtattactgtgcaagaggacggactcactggggcccccaggactttgactactggggccagggaaccctggtcaccgtctcctca

SEQ ID NO: 183 - DNA, 372 bp, Artificial Sequence
  chemically synthesized
caggtgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggaggaatgtattactatggttcggggagctcgtactttgactactggggccagggaaccctggtgaccgtctcctca

SEQ ID NO: 184 - DNA, 363 bp, Artificial Sequence
  chemically synthesized
caggtgcagctggtgcaatctgggggaggcttggtacagcctggggggtccctgagactctcctgtgcagcctctggattcacctttagcagctatgccatgagctgggtccgccaggctccagggaaggggctggaatgggtctcaggtattagtggtagtggtggtagcacatactacgcagactccgtgaagggccggttcaccatctccagagacaattccaagaacatgctgtttctgcaaatgaacagcccgagagccgaggacacggccgtatattactgtgcgaagaaaatagcagcagctggtaagcaacctgttgactactggggccagggaaccctggtcaccgtctcctca

SEQ ID NO: 185 - DNA, 393 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaggaaggtgtatgattacgtttgggggagttatcgcctccccgggtcggtatcgtactactttgactactggggccagggaaccctggtcaccgtctcctca

SEQ ID NO: 186 - DNA, 357 bp, Artificial Sequence
  chemically synthesized
caggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccggggagagcagctcgtccagactactggggccagggcaccctggtcaccgtctcctca

SEQ ID NO: 187 - DNA, 375 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggccccggggcagtggctggtactaagccaaagtactactttgactactggggccagggaaccctggtcaccgtctcctca

SEQ ID NO: 188 - DNA, 369 bp, Artificial Sequence
  chemically synthesized
gaggtccagctggtgcagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggccacgtattactatgatagtagtggttataggtttgactactggggccagggaaccctggtcaccgtctcctca

SEQ ID NO: 189 - DNA, 348 bp, Artificial Sequence
  chemically synthesized
gaggtccagctggtacagtctgggggaggcttggtagaaccgggggggtcccttagactctcctgtgcagcctctcgattcactttcagtgacgcctggatgagctgggtccgccaggctccaggtaaggggctggagtgggttggccgtattaaaagcaaaataagtggtgggacaacagactacgctgcacccgtgcaaggcagattcaccatctcaagagatgattcaaaaaacacgctgtatctgcaaatggacagcctgaaaaccgaggacacagccgtgtattactgtgcgaaccgaaacttaggctactggggccagggcaccctggtgaccgtctcctca

SEQ ID NO: 190 - DNA, 381 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccatgaccacagacacatccacgagcacagcctacatggagctgaggagcctgagatctgacgacacggccgtgtattactgtgcgagagctcgttactatgatagtagtggttatattgccccatcgggttactttgactactggggccagggaaccctggtcaccgtctcctca

SEQ ID NO: 191 - DNA, 366 bp, Artificial Sequence
  chemically synthesized
caggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatggccccgccgttgatggtgctgaatacttccagcactggggccagggcaccctggtcaccgtctcctca

SEQ ID NO: 192 - DNA, 369 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgcgaggccttgagtggctgggaaggacttactacaggtccaagtggtataatgattatgcagtatctctgaaaagtcgaataaccatcaacccggacacatccaagaaccagttctccctgcagctgaactctgtgactcccgaggacacggctgtatattactgtgcaagtttggcgagtggttccccccctccgggggactactggggccagggaaccctggtgaccgtctcctca

SEQ ID NO: 193 - DNA, 357 bp, Artificial Sequence
  chemically synthesized
caggtcaccttgaaggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaaaaaatactatgcaaactccgtgaagggccgattcaccatctccagagacaattccaagaacacgttgtatctgcaaatgaaaagtctgagagctgaggacacggctatgtattactgtgcgaaaggccctatagtgggagcgactatggactactggggccagggagccctggtcaccgtctcctca

SEQ ID NO: 194 - DNA, 354 bp, Artificial Sequence
  chemically synthesized
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatggtacggtgactacggccttgactactggggccagggaaccctggtcaccgtctcctca

SEQ ID NO: 195 - DNA, 384 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgcgtggatgggatggatcaacgctggcaatggtaacacaaaatattcagagaagttcgaaggcagagtcaccatcaccagggacacatccgcgagcacagcctacatggagctgagcagcctgagatctgaagacacggctgtgtattactgtgcgagggtcgccaaatattattacgagagtggtggttatcgggcctccaactggttcgacccctggggccagggcaccctggtcaccgtctcctca

SEQ ID NO: 196 - DNA, 381 bp, Artificial Sequence
  chemically synthesized
caggtgcagctgcaggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagcgccccctccgactgttggctggtacgcccccgtctttgactactggggccagggaaccctggtcaccgtctcctca

SEQ ID NO: 197 - DNA, 360 bp, Artificial Sequence
  chemically synthesized
cagctgcagctgcaggagtccgggggaggcttagttcagccgggggggtccctgagactctcctgctcagcctctggaatcagcttcagagattactggatgcactggatccgccaaactccagggaaggggctggtgtgggtctcacgtattaatcctgatgggagtagcacaagctacgcggactccgtgaagggccgattcaccatctccagagacaattccaagaacacgctgtatctgcaaatgaacagcctgagagctgaggacacggctgtgtattactgtgcgaaagttacgggacggagagtgggagcccatgactactggggccagggaaccctggtcaccgtctcctca

SEQ ID NO: 198 - DNA, 363 bp, Artificial Sequence
  chemically synthesized
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcctttgcccagccgggcgctgagacgttgaacttcgatctctggggccgtggcaccctggtcaccgtctcctca

SEQ ID NO: 199 - DNA, 360 bp, Artificial Sequence
  chemically synthesized
caggtacagctgcagcagtcaggtccaggactggtgaagccctcgcagaccctctcactcacctgtgccatctccggggacagtgtctctagcaaaagtgctgcttggaactggatcaggcagtccccatcgagaggccttgagtggctgggaaggacatactacaggtccaaatggaataatgattatgcattatctgtgaaaagtcgaataaccatcaacccagacacatccaagaaccagttctccctgcagctgaagtctgtgactcccgaggacacggctctgtattactgtgtaagacaagtcgcgggcggtatggacgtctggggccaagggaccacggtcaccgtctcctca

SEQ ID NO: 200 - DNA, 369 bp, Artificial Sequence
  chemically synthesized
caggtgcagctggtgcaatctgggggaggcttggtacagccagggcggtccctgagactctcctgtacagcttctggattcacctttggtgattatgctatgagctggttccgccaggctccagggaaggggctggagtgggtctcagctattagtggtagtggtggtagcacatactatgcagactccgtgaagggccgattcaccatctccagagacaattccaagaacacgctgtatctgcaaatgaacagcctgagagctgaggacacggctgtgtattactgtgcgaaaggatcggtatatagtgggagctactatatgctcattgactactggggccagggcaccctggtcaccgtctcctca

SEQ ID NO: 201 - DNA, 375 bp, Artificial Sequence
  chemically synthesized
caggtacagctgcagcagtcaggtccaggactggtgaggccctcgcagaccctctcactcacctgtgtcatctccggggacagtgtctctagcggcagtgctgcttggaactggatcaggcagtccccatcgagaggccttgagtggctgggaaggacatattatagggccaagtggtataatgaatatgcagggtctgtgaaaagccgaataaccatcagtccggacacatccaagaaccagttctccctgcaactgaactctgtgactcccgaggacacggctgtgtatttctgtacaagacaagacaaagacaacacgagatattccggtttgggcgtctggggccaagggaccacggtgaccgtctcctca

SEQ ID NO: 202 - DNA, 369 bp, Artificial Sequence
  chemically synthesized
gaggtgcagctggtggagaccgggggaggcttagttcagcctggggggtccctgagactctcctgtgcagcctctgaattcacccttaggaactatggcgtgagctgggtccgccaggctccagggaaggggctggagtgggtctcaggtatgagtggtagtggttatagtacatactacgcagactccgtgaagggccggttcaccatctccagagacagttccaagaacacgctgtttctgcaaatggacagcctgagagccgaggacacggccatatattactgtgcgagagggccccgaatgtggagcagtggcattgatgcttttgatatctggggccacgggacaatggtgaccgtctcttca

SEQ ID NO: 203 - DNA, 348 bp, Artificial Sequence
  chemically synthesized
caggtgcagctacagcagtggggcgcaggactgttgaagccttcggagaccctgtccctcacctgcgctgtctatggtgggtccgtcagtggttactactggagctggatccgccagcccccagggaaggggctggagtggatgggggaaatccatcatagtggaagcaccaactacaacccgtccctcaagagtcgagtcaccatatcactagacacgcccaagaaccagttctccctgaagctaagctctgtgaccgccgcggacacggctgtatattactgtgcgagacgggattgggcaggaaaaagggtctggggccagggaaccctggtcaccgtctcctca

SEQ ID NO: 204 - DNA, 366 bp, Artificial Sequence
  chemically synthesized
caggtacagctgcagcagtcaggtccaggactattaaagccctcgcagaccctctcactcacctgtgccatctccggggacagtgtctctagcaacactgctacttggaactggatcaggcagtccccatcgagaggccttgagtggctgggaaggacatactacaggtccaagtggtataaggataatgcactgtctgtgaaaagtcgaataaccatcaacccagacacatccaagaaccagttctccctgcagctgaactctgtgactcccgaggacacggctgtgtattactgtgcaggaggtcgggctggtattgccgcttttgatatctggggccaagggaccacggtcaccgtctcctca

SEQ ID NO: 205 - DNA, 360 bp, Artificial Sequence
  chemically synthesized
caggtgcagctggtgcaatctggaggaggcttgatccagcctggggggtccctgagactctcctgtgcagcctctgggttcaccgtcagtagcaactacatgagctgggtccgccaggctccagggaaggggctggaatgggtctcacttatttatagtgatggtcgcacaaactatgcagactccgtgaagggccgattcaccatctccagagacaattccaagaacacgctgtatctgcaaatgaacagcctgagagccgaggacacggccgtatattactgtgcgaagggggccctacagggcgaatggcggagatttgactactggggccagggcaccctggtcaccgtctcctca

SEQ ID NO: 206 - DNA, 378 bp, Artificial Sequence
  chemically synthesized
caggtgcagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataatgattatgcagtatctgtgaaaagtcgaataaccatcaacccagacacatccaagaaccagttctccctgcagctgaactctgtgactcccgaggacacggctgtgtattactgtacaagaaccaaccagggatacggtggtaactccggggtatttgactactggggccagggaaccctggtcaccgtctcctca

SEQ ID NO: 207 - DNA, 360 bp, Artificial Sequence
  chemically synthesized
caggtgcagctacagcagtcaggtccaggactggtgaagccctcgcagaccctctcactcacctgtgccatctccggggacagtgtctctggcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagttgaattctgtgactcccgaggacacggctgtgtattactgtgcgaggatagtgggaggtgccgttgactgctggggccagggaaccctggtgaccgtctcctca

SEQ ID NO: 208 - DNA, 372 bp, Artificial Sequence
  chemically synthesized
gaggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagttagagtgggagctactactgtttacgacagctggttcgacccctggggccagggaaccctggtgaccgtctcctca

SEQ ID NO: 209 - DNA, 387 bp, Artificial Sequence
  chemically synthesized
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggggggtccagcccatactatgatagtagtggtttactaccctggtacttcgatctctggggccgtggcaccctggtcaccgtctcctca

SEQ ID NO: 210 - DNA, 357 bp, Artificial Sequence
  chemically synthesized
caggtgcagctgcaggagtcggggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagctaagttttggacatactactttgactactggggccagggaaccctggtgaccgtctcctca

SEQ ID NO: 211 - DNA, 366 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcggtggttcggggagttattataagaggttctttgactactggggccagggaaccctggtcaccgtctcctca

SEQ ID NO: 212 - DNA, 381 bp, Artificial Sequence
  chemically synthesized
gaggtgcagctggtgcagtctggagctgaggtgaggaagcctggggcctcagtgaaggtctcctgcaaggcttctggttacacatttaccagttatgccatcagctgggtgcgacaggcccctggacaagggcttgagtggatggggtggatcagcgcttacgacggtaacacaaactatgcacagaagctccagggcagagtcaccatgaccacagacacatccacgagcacagcctacatggaggtgaggagcctgagatctgacgacacggccgtgtattactgtgcgagagatggtacggtccgaagggtagtgggagctactacccctggaaactttgactacaggggccagggaaccctggtcaccgtctcctca

SEQ ID NO: 213 - DNA, 372 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgaatcgaggatattgtagtggtggtagctgctttggctactggggccagggaaccctggtcaccgtctcctca

SEQ ID NO: 214 - DNA, 360 bp, Artificial Sequence
  chemically synthesized
caggtgcagctgcaggagtctgggggaggcttggtacagccgggggggtccctgagactctcctgtgcagcctctggattcacctttagcagctatgccatgagctgggtccgccaggctccagggaaggggctggagtgggtttcatacattagtagtagtggtactaccatatactacgcagactctgtgaagggccgattcaccgtctccagagacaatgccaagaactcactgtatctgcaaatgaacagcctgagagccgaggacacggccgtgtattactgtgcgagggattatagcagctcgggggagtgctttgactactggggccagggaaccctggtcaccgtctcctca

SEQ ID NO: 215 - DNA, 360 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcaggcagctatggtaggctactttgactactggggccagggaaccctggtcaccgtctcctca

SEQ ID NO: 216 - DNA, 369 bp, Artificial Sequence
  chemically synthesized
caggtcaccttgaaggagtctgggggaggcgtggtccagcctgggaggtccctgagactctcctgtgcagcctctggattcatcttcagtaactatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggacttttgcggggtatagcagcaaactggggtacttcgatctctggggccgtggcaccctggtcaccgtctcctca

SEQ ID NO: 217 - protein, 109 aa, Artificial Sequence
  chemically synthesized
ETTLTQSPATLSVSLGERATLSCRASQSIGSNLVWYQLKPGQGPRLVIYSATSRATGIPARFSGSGSGTEFILSISNLQSEDLAVYYCQQYGSSPPTTFGQGTRLEIKR

SEQ ID NO: 218 - protein, 109 aa, Artificial Sequence
  chemically synthesized
EIVMTQSPATLSLSPGERATLSCRASQSVSSSYLAWYQQKPGRAPRLLIYGASNRATGIPDRFSGSGSGTDFTLIISRLEPEDFALYYCQQYGSSPGTFGQGTKVDIKR

SEQ ID NO: 219 - protein, 108 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWPRTFGQGTKLEIKR

SEQ ID NO: 220 - protein, 114 aa, Artificial Sequence
  chemically synthesized
EIVLTQSPDSLAVSLGERATITCKSSRNILYSGNNKNFLAWYQHKPGQPPKLLIYWASTRESGVPDRFSGSGSGTDFTLTINSLEAEDAATYYCHQSSSLPHTFGPGTKVDIKR

SEQ ID NO: 221 - protein, 108 aa, Artificial Sequence
  chemically synthesized
ETTLTQSPGTLSLSPGQRATLSCRASESVSKSYLLWYQQKPGQAPRLLIYGASTRASGIPNRFSGSGSGTDFTLTISRLEPEDSAVYYCQHYGSSRTFGQGTRLEIKR

SEQ ID NO: 222 - protein, 111 aa, Artificial Sequence
  chemically synthesized
ETTLTQSPGTLSLSPGERATLSCRASQSISSTYLAWYQQKPGQAPRLLIYGASTRATGIPDRFSGSGSGTDFTLSISRLEPEDFAVYYCQQYGNSPPGATFGQGTRLEIKR

SEQ ID NO: 223 - protein, 114 aa, Artificial Sequence
  chemically synthesized
DIQLTQSPSSLSASVGERVTITCRSSQALRNVVGLGDDLAWYQHTPGSAPKILIYSTSTLQSGVSSRFSGGKSGRDFTLTIDRLQPGDSATYYCLQHHDFPFTFGPGTKVEIKR

SEQ ID NO: 224 - protein, 113 aa, Artificial Sequence
  chemically synthesized
DVVMTQSPLSLPVTPGEPASISCRSSQSLLNSNGYNYLEWYLQKPGQSPQLLIYLGSNRASGVPDRFSGSGSGTDFTLKISRVEADDAGVYYCMQSLQTPLTFGGGTKLEIKR

SEQ ID NO: 225 - protein, 110 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRITFGQGTRLEIKR

SEQ ID NO: 226 - protein, 110 aa, Artificial Sequence
  chemically synthesized
DVVMTQSPATLSVSPGERATLSCRASQSVSSNLAWYQQKPGQAPRLLIYGASTRATGIPARFSGSGSGTEFTLTISSLQSEDFAVYYCQQYNNWPPMYTFGQGTKLEIKR

SEQ ID NO: 227 - protein, 108 aa, Artificial Sequence
  chemically synthesized
DVVMTQSPATLSVSPGERVTLSCRASQSVRDNVGWYKQKPGQPPRLVIYGASTRATGIPARISGSGSGTEFTLTISSLQSEDFAVYYCQQFNNWPYTFGQGTKLEIKR

SEQ ID NO: 228 - protein, 108 aa, Artificial Sequence
  chemically synthesized
DIQMTQSPSSLSASVGDRVTITCRASQSISSYLNWYQQKPGKAPNLLIYAASSLHTGVPSRFSGSGSGTDFTLTISSLQPEDFATYYCQQSYSIPRTFGQGTKVEIKR

SEQ ID NO: 229 - protein, 109 aa, Artificial Sequence
  chemically synthesized
DVVMTQSPATLSVTPGERATLSCRASQSVNSNVAWYQQKPGQAPRLLIYDVSTRATDIPARFSGSGSGTDFTLTISRLDPEDFAVYYCQQCASSPPVTFGGGTKLEIKR

SEQ ID NO: 230 - protein, 110 aa, Artificial Sequence
  chemically synthesized
EIVMTQSPATLSLSPGERATLSCGASQSVSSSYLAWYQQKPGLAPRLLIYDASSRATGIPDRFSGSGSGTDFTLTISRLEPEDFAVYYCQQYGSSPRVTFGGGTKVDIKR

SEQ ID NO: 231 - protein, 109 aa, Artificial Sequence
  chemically synthesized
DVVMTQSPGTLSLSPGERATLSCRASQSVSSSALAWFQQKPGQAPRLLIYDSSSRATGIPDSFSGSGSGTEFTLTISSLQPEDFATYYCQQFNTYPNTFGQGTKLEIKR

SEQ ID NO: 232 - protein, 112 aa, Artificial Sequence
  chemically synthesized
DIQMTQSPLSLPVTPGEPASISCRSSQSLLHSNGYNYLDWFLQKPGQSPRLLIYMGSSRASGVPERFSGSGSGTDFTLKISRVEAEDVGVYYCMQTLHTVTFGGGTKVEIKR

SEQ ID NO: 233 - protein, 108 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSLLFGQGTRLEIKR

SEQ ID NO: 234 - protein, 109 aa, Artificial Sequence
  chemically synthesized
DIQLTQSPSFLSASVGDRVTITCRASQGISSSLAWYQQKPGKAPKLLIYAASTLQSGVPSRFSGSGSGTDFTFTISSLQPEDIATYYCQQYDNLPPLTFGGGTKVEIKR

SEQ ID NO: 235 - protein, 113 aa, Artificial Sequence
  chemically synthesized
DVVMTQSPLSLPVTPGEPASISCRSSQSLLHSNGYNYLDWYLQKPGQSPQLLIYLGSNRASGVPDRFSGSGSGTDFTVKISRVEAEDVGVYYCMQALQTPYTFGQGTKLEIKR

SEQ ID NO: 236 - protein, 113 aa, Artificial Sequence
  chemically synthesized
EIVLTQSPLSLPVTLGQPASISCRSCQSLVYSDGNTYLNCFQQRPGQSPRRLIYKVSNRDSGVPDRFSGSGSGTDFTLEISRVEAEDVGIYFCMQGLQTPFTFGPGTKVDIKR

SEQ ID NO: 237 - protein, 110 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSPALTFGGGTKLEIKR

SEQ ID NO: 238 - protein, 113 aa, Artificial Sequence
  chemically synthesized
EIVMTQSPLSLPVTPGEPASISCRSSQSLLHSNGYNYLDWYLQKPGQSPQLLIYLGSTRASGVPDRFSGSGSGTDFTLKISRAEAEDVGVYYCMQALHTPWTFGLGTKVDIKR

SEQ ID NO: 239 - protein, 109 aa, Artificial Sequence
  chemically synthesized
DIQMTQSPATLSVSPGERATLFCRASEGLTTNLAWYQHKPGQAPRLLIYAASTRATGVPARFSGSGSGTDFTLTISSLQSEDSAVYYCQQYNHWPLYTFGQGTKVEIKR

SEQ ID NO: 240 - protein, 108 aa, Artificial Sequence
  chemically synthesized
DIQLTQSPSTLSLSPGERATLSCRASQSVSSYLAWYQQKSGQAPRLLIYDASNRATGIPARFSGSGSGTDFTLTISSLEPEDFAVYYCQQGSNWPLTFGGGTKVEIKR

SEQ ID NO: 241 - protein, 113 aa, Artificial Sequence
  chemically synthesized
DIVMTHTPLSSPVTLGQPASISCRSSQSLEHTDGNTYLSWLHQRPGQPPRLLIYKVSTRFSGVPDRFSGSGAGTDFTLKISRVEAEDVGVYYCVQATHYPRTFGHGTKVEIKR

SEQ ID NO: 242 - protein, 110 aa, Artificial Sequence
  chemically synthesized
EIVLTQSPGTLSLSPGERATLSCRASQSISGSYLAWYQQKRGQAPRLLIYDASSRAEGIPDRFIGSGSGTDFTLTISRLEPEDFAMYYCQQYGSSPIFTFGPGTKVDIKR

SEQ ID NO: 243 - protein, 113 aa, Artificial Sequence
  chemically synthesized
EIVLTQSPDSLPVTPGEPASISCRSSQSLLHSNGNNYLDWYLQKPGQSPQLLIYLGSNRASGVPDRFSGSGSGTDFTLKLSRVEAEDVGVYYCMQGLQIPITFGPGTKVDIKR

SEQ ID NO: 244 - protein, 108 aa, Artificial Sequence
  chemically synthesized
DIQMTQSPSSVSASVGDRVTITCRASQNIRHWLVWYQQKLGQAPKLLIYAASNLQSGVPSRFSGSGSGTEFTLTINSLQAEDFATYYCLQHNSYPWTFGQGTKVEIKR

SEQ ID NO: 245 - protein, 108 aa, Artificial Sequence
  chemically synthesized
EIVLTQSPDFQSVTPKQKVTITCRASQSIGGSLHWYQQKPGQSPKLIIKYASQSFSGVPSRFSGSGSGTDFTLTIDSLEAEDAATYYCHQSISLPLTFGGGTKVDIKR

SEQ ID NO: 246 - protein, 108 aa, Artificial Sequence
  chemically synthesized
ETTLTQSPGTLSLSPGEGATLSCRASQSVTSNYLAWYQQKPGQAPRLLIYGASYRATGIPDRFSGSGSGTDFTLTISRLEPEDFAVYYCQQYASSVTFGQGTRLEIKR

SEQ ID NO: 247 - protein, 108 aa, Artificial Sequence
  chemically synthesized
DVVMTQSPATLSVSPGERATLSCRASQSISSNLAWYQQKPGQAPRLLIYGASTRATGIPARFSGSGSGTEFTLTISSLQSEDFAVYYCQQYNNWPRTFGQGTKLEIKR

SEQ ID NO: 248 - protein, 114 aa, Artificial Sequence
  chemically synthesized
DIQLTQSPDSLAVSLGERATINCKSSQSVLYSSNNKNYLAWYQQKPGQPPKLLIYWASARESGVPDRFSGSGSGTDFTLTINSLQAEDVAVYYCQQFYSPPRTFGQGTKVEIKR

SEQ ID NO: 249 - protein, 110 aa, Artificial Sequence
  chemically synthesized
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPGTFGGGTKVDIKR

SEQ ID NO: 250 - protein, 109 aa, Artificial Sequence
  chemically synthesized
EIVLTQSPGTLSLSPGERATLSCRASQSLSTNLAWYQQKPGQAPRLLIYGASTRATGIPARFSGSGSGTEFTLTITSLQSEDFAVYYCQQYHNWPPYTFGQGTKVEIKR

SEQ ID NO: 251 - protein, 107 aa, Artificial Sequence
  chemically synthesized
DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIKR

SEQ ID NO: 252 - protein, 109 aa, Artificial Sequence
  chemically synthesized
ETTLTQSPGTLSLSPGEGATLSCRASHSVGANYIAWYQQKPGQAPRLLIHTASKRATGVPERFSGSGSGTDFTLSISRLEPEDFAVYHCQQYAAAPITFGQGTRLEIKR

SEQ ID NO: 253 - protein, 108 aa, Artificial Sequence
  chemically synthesized
EIVMTQSPSSLSASVGDRVIITCRASQGIANYLAWYQQKPGKGPKLLIYASSTLQSGVPSRFSGSGSGTDFTLTISGLQPEDVATYYCQKYNSVPLTFGGGTKVDIKR

SEQ ID NO: 254 - protein, 114 aa, Artificial Sequence
  chemically synthesized
DVVMTQSPVSLAVSLGERATINCKSSQSVLYRTNNKNYLAWYQQKPGQPPKLLIYWASTRESGVPDRFSGSGSGTDFTLTISSLQPEDVAVYYCQQYYNLPRSFGQGTKLEIKR

SEQ ID NO: 255 - protein, 114 aa, Artificial Sequence
  chemically synthesized
DIVMTHTPDSLAVSLGERATINCKSNRSVLYSPNNQNYLGWYQQKPGQPPKLLIYWASTRDSGAPDRFSGSGSGTDFTLTINSLQAEDVAVYYCQQYASTPYTFGQGTKVEIKR

SEQ ID NO: 256 - protein, 109 aa, Artificial Sequence
  chemically synthesized
DVVMTQSPATLSLSPGERATLSCRASESVNSNFLAWYQQKPGQAPRLLIYAASTRATGIPARFSGSGSGTEFTLIITSLQSEDFAVYYCQQYNNWPLTFGGGTKLEIKR

SEQ ID NO: 257 - protein, 108 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWSLTFGGGTKLEIKR

SEQ ID NO: 258 - protein, 110 aa, Artificial Sequence
  chemically synthesized
ETTLTQSPGTLSLSPGERATLSCRASQSVSSSYLAWYQQKPGQAPRLLIYGASTRATGIPDRFSGSGSGTDFTLTIGRLEPEDFAVYYCQHYGPSRRITFGQGTRLEIKR

SEQ ID NO: 259 - protein, 107 aa, Artificial Sequence
  chemically synthesized
ETTLTQSPDTLSVSPGGRATLSCRASQSIGSNLAWYQQKPGQSPRLLIYDASTRATGIPARFSGSGSGTEFTLTISSLESEDFVLYYCQQHGEWPTFGQGTRLEIKR

SEQ ID NO: 260 - protein, 109 aa, Artificial Sequence
  chemically synthesized
DVVMTQSPATLSLSPGERATLSCRASQSVGNSLAWYQQKPGQAPRLLIYDASNRATGIPARFSGSGSGTDFTLTITSLEPEDFAIYYCQQRGTWPPLTFGGGTKLEIKR

SEQ ID NO: 261 - protein, 108 aa, Artificial Sequence
  chemically synthesized
DVVMTQSPSSLSASVGDTVTITCRASQSITNWLAWYQQKPGKAPKRLIYGASSLQSGVPSRFSGSGSGTEFTLTISSLQPEDFATYYCQQYTNYPRTFGQGTKLEIKR

SEQ ID NO: 262 - protein, 107 aa, Artificial Sequence
  chemically synthesized
DIQMTQSPSTLSASVGDRVTITCRARQSISNRLAWYQQKPGRAPNVLIYKASTLANGVPSRFSGSGSGTEFTLTISSLQPDDFATYYCQQYQSYWTFGPGTKVEIKR

SEQ ID NO: 263 - protein, 108 aa, Artificial Sequence
  chemically synthesized
DIQLTQSPATLSLSPGERATLSCKASQSVSSYLAWYQQKLGQAPRLLIYDASNRATGIPARFSASGSGTDFTLTISSLQPEDVATYYCQKYNSPPRTFGQGTKVEIKR

SEQ ID NO: 264 - protein, 109 aa, Artificial Sequence
  chemically synthesized
ETTLTQSPGTLSLSPGERVSLSCRASQNVYSNFLAWYQQRPGQAPSLLIYGASSRAAGVPDRFSGSGSGTDFALTISRVEPEDFAVYYCQQYGTSPITFGQGTRLEIKR

SEQ ID NO: 265 - protein, 113 aa, Artificial Sequence
  chemically synthesized
EIVLTQSPRSSPVTLGQPASISCRSSQSLEHGDGNTYLSWLQQRPGQPPRLLIYKVSNRLSGVPDRFSGSGAGTDFTLKISRVEAEDVGVYYCMQGIYWPRTFGQGTRLEIKR

SEQ ID NO: 266 - protein, 110 aa, Artificial Sequence
  chemically synthesized
ETTLTQSPVTLSLSPGDRATLSCRASQSVSSTSLAWYQHKPGQAPRLLIYGASRRATGIPDRFSGSGSGTDFTLTINRLEPEDFAVYYCQHYGSSPPITFGQGTRLEIKR

SEQ ID NO: 267 - protein, 109 aa, Artificial Sequence
  chemically synthesized
ETTLTQSPATLSVSPGERATLSCRASQSVGSKLAWYQQKPGQAPRLLIYGASTRATGVPVRFSGSGSGTEFTLTISSLQSEDFAVYYCQQYNNWPPITFGQGTRLEIKR

SEQ ID NO: 268 - protein, 113 aa, Artificial Sequence
  chemically synthesized
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGGGTKVDIKR

SEQ ID NO: 269 - protein, 115 aa, Artificial Sequence
  chemically synthesized
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSTPYTFGQGTKLEIKR

SEQ ID NO: 270 - protein, 113 aa, Artificial Sequence
  chemically synthesized
DIVMTHTPLSLSVTPGQPASISCKSSQSLLGGDGKTYLYWYLQKPGQPPQLLLYEVSNRFSGVPDRFSGSGAATDFTLKISRVEAEDVGVYYCMQSTQFPWTFGQGTKVEIKR

SEQ ID NO: 271 - protein, 110 aa, Artificial Sequence
  chemically synthesized
ETTLTQSPGTLSLSAGERATLSCRASQSVSSSYLAWYQQKPGQAPRLLIYAASYRATGIPDRFSGRGSGTEFTLTISSLQSEDFAVYYCQQYNNWPPITFGQGTRLEIKR

SEQ ID NO: 272 - protein, 108 aa, Artificial Sequence
  chemically synthesized
DVVMTQSPATLSVSPGERATLSCRASQSVSSNLAWYQQKPGQAPRLLIYDASTRATGIPARFSGSGSGTEFTLTISSLQSEDFAVYYCQHYNNWPHTFGQGTKLEIKR

SEQ ID NO: 273 - protein, 108 aa, Artificial Sequence
  chemically synthesized
ETTLTQSPGTLSLSPGERATLSCRASQSVSSNSLAWYQQKPGQAPRLLIYGASSRASGIPDRFNGSGSGTDFTLTINRLEPEDFAVYYCQQYGNSQTFGQGTRLEIKR

SEQ ID NO: 274 - protein, 108 aa, Artificial Sequence
  chemically synthesized
DVVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKLEIKR

SEQ ID NO: 275 - protein, 113 aa, Artificial Sequence
  chemically synthesized
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGGGTKLEIKR

SEQ ID NO: 276 - protein, 108 aa, Artificial Sequence
  chemically synthesized
DIQMTQSPSTLSASVGDRVTITCRASQSISRWLAWYQQKPGKAPKLLIYKASTIKSGVPSRFSASGSGTEFTLTISSLQPEDFATYYCQHYKSDSRTFGQGTKVEIKR

SEQ ID NO: 277 - protein, 107 aa, Artificial Sequence
  chemically synthesized
DVVMTQSPSSLAASVGDRITITCRPSQDIGTYLNWYQQKAGEAPKLLIYAASNLHSGVSSRFRGVGSGTQFTLTISSLQPEDFATYYCHQSYGPRTFGQGTKLEIKR

SEQ ID NO: 278 - protein, 109 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPPITFGQGTRLEIKR

SEQ ID NO: 279 - protein, 109 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSGYTFGQGTKLEIKR

SEQ ID NO: 280 - protein, 106 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSFGQGTRLEIKR

SEQ ID NO: 281 - protein, 108 aa, Artificial Sequence
  chemically synthesized
EIVLTQSPSTLSASVGDRVTITCRASQSISSCLAWYQQKPGKAPKLLIYAASTLQSGVPSRFSGSGSGTEFTLTISTLQPEDFATYYCQQLNSYPQTFGQGTKVDIKR

SEQ ID NO: 282 - protein, 113 aa, Artificial Sequence
  chemically synthesized
DIVMTHTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPLTFGGGTKVEIKR

SEQ ID NO: 283 - protein, 109 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYNNWPLTFGGGTKLEIKR

SEQ ID NO: 284 - protein, 114 aa, Artificial Sequence
  chemically synthesized
DIQLTQSPDSLAVSLGERATINCTSSQSVLYSSNNKNYIAWYQQKPGQPPKLLIYWASTRESGVPDRFSGSGSGTDFTLTISSLQAEDVAVYYCQQYYYIPRTFGQGTKVEIKR

SEQ ID NO: 285 - protein, 112 aa, Artificial Sequence
  chemically synthesized
DVVMTQSPLSLPVTPGEPASISCRSSQSLLHSNGYNYLDWYLQKPGQSPQLLIYLGSNRAPGVPDRFSGSGSGTDFTLKISRVEAEDVGVYYCMQALQTRTFGQGTKLEIKR

SEQ ID NO: 286 - protein, 109 aa, Artificial Sequence
  chemically synthesized
ETTLTQSPGTLSLSPGERATLSCRASQSLTSSYLAWYQQKPGQAPRLLIYRASSRATGIPDRFSGSGSGTDFTLTISRLEPEDFAVYYCQQYGSSPNTFGQGTRLEIKR

SEQ ID NO: 287 - protein, 114 aa, Artificial Sequence
  chemically synthesized
EIVLTQSPLSLPVTLGQPASISCRSSQSLVHSNGHTYLSWFQQRPGQSPRRLIYEVSNRDSGVPDRFSGSGSGTDFTLRISRVEAEDVGVYYCLQGTHWPPLTVGGGTKVDIKR

SEQ ID NO: 288 - protein, 108 aa, Artificial Sequence
  chemically synthesized
DVVMTQSPATLSLSPGERATLSCRASQSVGSDLAWYQQKPGQAPRLLIYRASTRAAGIPARFSGSGSGTDFTLTISRLEPEDFAVFYCQQYGRSPYTSGQGTKLEIKR

SEQ ID NO: 289 - protein, 114 aa, Artificial Sequence
  chemically synthesized
DIVMTHTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKR

SEQ ID NO: 290 - protein, 113 aa, Artificial Sequence
  chemically synthesized
EIVMTQSPLSLSVTPGEPASISCRSSQSLLHSSGYNYLDWYLQKPGQSPQLLIYLGSTRASGVPDRFSGSGSGTDFTLKISRVEAEDVGVYYCMQGLQIPLTFGGGTKVDIKR

SEQ ID NO: 291 - protein, 113 aa, Artificial Sequence
  chemically synthesized
DIVMTHTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPWTFGQGTKVEIKR

SEQ ID NO: 292 - protein, 107 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPRFGQGTRLEIKR

SEQ ID NO: 293 - protein, 108 aa, Artificial Sequence
  chemically synthesized
DVVMTQSPSTLSASVGDRVTITCRASQTINSWLAWYQQKPGKAPKLLISRASRLESGVPSRFSGSASGTEYILTINSLQPDDFAMYFCHQYNSYSPTFGQGTKLEIKR

SEQ ID NO: 294 - protein, 109 aa, Artificial Sequence
  chemically synthesized
ETTLTQSPGTLSLSPGERATLSCRASQSVSSSYLAWYQQKPGQAPRLLIYGASSRATGIPARFSGSGSGTDFTLTISSLEPEDFAVYYCQQRYNWPITFGQGTRLEIKR

SEQ ID NO: 295 - protein, 108 aa, Artificial Sequence
  chemically synthesized
EIVLTQSPATLSLSPGETATLSCRASQTIGPKSFGWYQQRPGQAPRLLIYDSNRATGIPARFSGSGSGTDFTLTISSLEPEDFAVYYCQQRSRWPLTFGPGTKVDIKR

SEQ ID NO: 296 - protein, 113 aa, Artificial Sequence
  chemically synthesized
DVVMTQSPLSLPVTLGQPASISCRSSQSLVYSDGNTYLYWFQQRAGQSPRRLIYKVSKRDSGVPDRFSGSGSGTDFTLKISRVEAEDVGIYYCVQGRHWPYTLGQGTKLEIKR

SEQ ID NO: 297 - protein, 109 aa, Artificial Sequence
  chemically synthesized
EIVLTQSPGTLSLSPGERATLSCRASQSVSSSYLAWYQQKPGQAPRLLIYDASNRATGIPARFSGSGSGTEFTLTISSLQPDDFATYYCQQYNSYSRTFGQGTKVDIKR

SEQ ID NO: 298 - protein, 108 aa, Artificial Sequence
  chemically synthesized
DVVMTQSPSTLSASVGDRVTITCRASQSITTWLAWSQQQPGKAPKLLIYKASSLTSGVPSRFSGSGSGTEFTLTISSLQPDDFASYYCHHYNGASRMFGQGTKLEIKR

SEQ ID NO: 299 - protein, 107 aa, Artificial Sequence
  chemically synthesized
ETTLTQSPATLSLSPGERATLSCRASQSVSSYLAWYQQKPGQAPRLLIYDASNRATGIPARFSGSGSGTDFTLTISSLEPEDFAVYYCQQRSNWPFFGQGTRLEIKR

SEQ ID NO: 300 - protein, 108 aa, Artificial Sequence
  chemically synthesized
ETTLTQSPATLTLSPGERVTLSCRASQSIGTYVAWYQQKPGQAPRFLIYDSSNRATGIPARFSGSGSGTDFTLTISSLEPEDFAFYYCQQRAEWPLTFGQGTRLEIKR

SEQ ID NO: 301 - protein, 110 aa, Artificial Sequence
  chemically synthesized
DVVMTQSPGTLSLSPGERATLSCRASQSVNSGYLAWYQQKPGQPPRLLISGVSTRATGIPDRFSGSGSGTDFTLTISRLEPEDFAVYYCQEYGNSAMYNFGQGTKLEIKR

SEQ ID NO: 302 - protein, 109 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPPFTFGQGTRLEIKR

SEQ ID NO: 303 - protein, 109 aa, Artificial Sequence
  chemically synthesized
DVVMTQSPGTLSLSPGERATLSCRASQSVSSSYLGWYQQKSGQAPRLLIYGASSRATDIPDRFSGSGSGTDFTLTISKLEAEDSAVYYCQQYGISPLAFGQGTKLEIKR

SEQ ID NO: 304 - protein, 109 aa, Artificial Sequence
  chemically synthesized
ETTLTQSPATLSVSPGERATLSCRASQSISNNLAWYQQKPGQAPRLLIYGTSTRATGIPARFSGSGSGTEFTLTISSLQSEDFAVYYCQQYNFWPSITFGQGTRLEIKR

SEQ ID NO: 305 - protein, 108 aa, Artificial Sequence
  chemically synthesized
ETTLTQSPGTLSLSPGERATLSCRASQSVSSSSLAWYQQKPGQAPRLLIYGASSRATGIPDRFSGSGSGTDFTLTISRLEPEDFAVYYCQQYGSSQTFGQGTRLEIKR

SEQ ID NO: 306 - protein, 113 aa, Artificial Sequence
  chemically synthesized
DVVMTQSPLSLPVSLGQPASISCRSNQSLVYSDGGTYLNWFQQRAGQSPRRLVYKVSNRDSGVPDRFSGSGSGTDFTLRISRVEAEDVGVYYCMQGTHWPYTFGQGTKLEIKR

SEQ ID NO: 307 - protein, 108 aa, Artificial Sequence
  chemically synthesized
DIQLTQSPSSLSASVGDRVTVTCRASQSISSYLNWYQQKPGKAPQLLIYDASNLETGVPSRFSGSGSGTDFTFTISSLQPEDFATYYCQQFDNVPVTFGGGTKVEIKR

SEQ ID NO: 308 - protein, 113 aa, Artificial Sequence
  chemically synthesized
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKLEIKR

SEQ ID NO: 309 - protein, 109 aa, Artificial Sequence
  chemically synthesized
DVVMTQSPATLSVSPGERATLSCRASQSVSSNLAWYQQKPGQAPRLLIYGASSRATGIPDRFSGSGSGTDFTLTINRLEPEDFAVYYCQQYGSSSMYTFGQGTKLEIKR

SEQ ID NO: 310 - protein, 108 aa, Artificial Sequence
  chemically synthesized
DVVMTQSPSSLSASVGDSVAITCRASQSISNYLNWYQQRPGKAPKLLIFAASSLQSGVPSRFSGSGSGTDFTLTISSLQPEDFATYSCQQSYITPWTFGQGTKLEIKR

SEQ ID NO: 311 - protein, 108 aa, Artificial Sequence
  chemically synthesized
DVVMTQSPGTLSLSPGERATLSCRASQSVSTLLAWYQQKPGQAPRLLIYDASNRATGIPGRFSASGSGTDFSLTISSLETEDSAVYYCQHRYVWPFTFGGGTKLEIKR

SEQ ID NO: 312 - protein, 108 aa, Artificial Sequence
  chemically synthesized
DIQMTQSPSSLSASVGDRVTITCRASQGIRNDLGWYQQKPGKAPKRLIYGASSLQSGVPSRFSGSGSGTEFTLTIRSLQPEDFATYYCLQHNSYPRTFGQGTKVEIKR

SEQ ID NO: 313 - protein, 108 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKLEIKR

SEQ ID NO: 314 - protein, 113 aa, Artificial Sequence
  chemically synthesized
DVVMTQSPLSLPVTLGQAASISCRSSHSLTTTDGRTYVAWFQQRPGQSPRRLLYEVSKRDSGAPDRFSGSGSGTDFTLKISRVEADDVGIYHCMQGTHGPHTFGQGTKLEIKR

SEQ ID NO: 315 - protein, 109 aa, Artificial Sequence
  chemically synthesized
ETTLTQSPATLSVSPGERATLSCRASQSVTSNLAWYQQKPGQAPRLLIYGASNRATGIPARFSVSGSGTDFTLTISRLEPEDFAVYYCQQYGSPPPTTFGQGTRLEIKR

SEQ ID NO: 316 - protein, 109 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSRRTFGQGTKLEIKR

SEQ ID NO: 317 - protein, 109 aa, Artificial Sequence
  chemically synthesized
ETTLTQSPGTLSLSPGERATLSCRASQSVFNNYLAWYQQRPGQAPRLLIYGASSRATGIPDRFSGGGSGTDFTLTISRLEPEDFAVYCCQQYGSSPITFGQGTRLEIKR

SEQ ID NO: 318 - protein, 109 aa, Artificial Sequence
  chemically synthesized
EIVLTQSPATLSLSPGERATLSCRASQSVSSYLAWYQQKPGQAPRLLIYDASNRATGIPARFSGSGSGTDFTLTISRLEPEDFAVYYCQQYGSSLRYTFGQGTKLEIKR

SEQ ID NO: 319 - protein, 113 aa, Artificial Sequence
  chemically synthesized
EIVLTQSPDSLAVSLGERATINCKSSQSVLYDSNSKNYLSWYQQKPGQPPKLLISWASTRGSGVPDRFSGSGSGTDFTLTISSLQAEDVAVYYCQQFYGIPHFGQGTRLEIKR

SEQ ID NO: 320 - protein, 109 aa, Artificial Sequence
  chemically synthesized
DVVMTQSPATLSLSPGERATLSCRASQSVGTNLAWYQQKPGQAPRLLIYDASNRATGIPARFSGSGSGTEFTLTISSLQSEDFAVYYCQQYNNWPPITFGGGTKLEIKR

SEQ ID NO: 321 - protein, 113 aa, Artificial Sequence
  chemically synthesized
DVVMTQSPLSLPVTLGQPASISCRSSQSLVYSDGNTYLSWLQQRPGQPPRLLIYKISNRFSGVPDRFSGSGAGTDFTLKISRVEAEDVGVYYCMQGTQFPQTFGQGTKLEIKR

SEQ ID NO: 322 - protein, 110 aa, Artificial Sequence
  chemically synthesized
EIVLTQSPGTLSLSPGERATLSCRASQSVISRYLAWYQQKPGQAPRLLIHGASTRATGIPDRFSGSGSGTDFTLTISRLEPEDFAVYYCQQYGSSPPYTFGQGTKVEIKR

SEQ ID NO: 323 - protein, 108 aa, Artificial Sequence
  chemically synthesized
DIQLTQSPSTLAASVGDRVTITCRASQSISSWLAWYQQKPGKAPKVLIYKASSLESGVPSRFSGSGSGTEFTLTISSLQPDDFATYYCQQYNSYSGTFGQGTKVEIKR

SEQ ID NO: 324 - protein, 108 aa, Artificial Sequence
  chemically synthesized
DVVMTQSPAILSVSPGERATLSCRASQSVSSSLAWYQQKPGQPPRLLIYGASTRATAIPARFSGSGSGTEFTLTISSLQSEDFAVYYCQRYDNWPPLFGQGTKLEIKR

SEQ ID NO: 325 - DNA, 327 bp, Artificial Sequence
  chemically synthesized
gaaacgacactcacgcagtctccagccaccctatctgtgtctctaggagaaagagccaccctttcttgcagggccagtcagagtattggcagcaacttagtctggtaccagctgaaacctggccagggtcccaggctcgtcatatatagtgcaacctctagggccactggaatcccagccaggttcagcggcagtgggtctgggacagagttcattctctccatcagcaacctgcagtctgaagatcttgcagtttattactgtcagcagtatggtagttcacctccgaccaccttcggccaagggacacgactggagattaaacgt

SEQ ID NO: 326 - DNA, 327 bp, Artificial Sequence
  chemically synthesized
gaaattgtgatgacacagtctccagccaccctgtctttgtctccaggggaaagagccaccctctcctgcagggccagtcagagtgttagcagcagctacttagcctggtaccagcaaaaacctggccgggctcccaggctcctcatctatggcgcatccaacagggccacaggcatcccagacaggttcagtggcagtgggtctgggacagacttcactctcatcatcagcagactggagcctgaagattttgccttgtattactgtcagcagtatggaagctcaccgggaacgttcggccaagggaccaaagtggatatcaaacgt

SEQ ID NO: 327 - DNA, 324 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcggacgttcggccaagggaccaagctggagatcaaacgt

SEQ ID NO: 328 - DNA, 342 bp, Artificial Sequence
  chemically synthesized
gaaattgtgttgacgcagtctccagactccctggctgtgtctctgggcgagagggccaccatcacctgcaagtccagccggaatattttatacagcggcaacaataaaaacttcttggcttggtatcagcacaaaccaggacagcctcctaagttgctcatttactgggcatctacccgggaatccggggtccctgaccgatttagtggcagcgggtctgggacagatttcaccctcaccatcaatagcctggaagctgaagatgctgcaacgtattactgtcatcagagtagtagtttacctcacactttcggccctgggaccaaagtggatatcaaacgt

SEQ ID NO: 329 - DNA, 324 bp, Artificial Sequence
  chemically synthesized
gaaacgacactcacgcagtctccaggcaccctgtctttgtctccagggcaaagagccaccctctcctgcagggccagtgagagtgttagcaagagctacttactctggtaccagcagaaacctggccaggctcccagactcctcatctatggtgcatccaccagggccagtggcatcccaaacaggttcagtggcagtgggtctgggacagacttcactctcaccatcagcagactggagcctgaagattctgcagtgtattactgtcagcactatggcagctctcgcaccttcggccaagggacacgactggagattaaacgt

SEQ ID NO: 330 - DNA, 333 bp, Artificial Sequence
  chemically synthesized
gaaacgacactcacgcagtctccaggcaccctgtctttgtctccaggggaaagagccaccctctcctgcagggccagtcagagtattagcagcacctacttagcctggtaccagcagaaacctggccaggctcccaggctcctcatctatggtgcatccaccagggccactggcatcccagacaggttcagtggcagtgggtctgggacagacttcactctcagcatcagcagactggagcctgaagattttgcagtgtattactgtcagcagtatggtaactcacctccgggagccaccttcggccaagggacacgactggagattaaacgt

SEQ ID NO: 331 - DNA, 342 bp, Artificial Sequence
  chemically synthesized
gacatccagttgacccagtctccttcctccctgtctgcatctgtgggagaaagagtcaccatcacttgccggtccagccaggccctgcgaaatgttgtcggccttggcgatgatttagcctggtatcaacacacgccaggcagcgcccccaagatcctgatctactctacatcgactttacaaagtggagtctcatcaagattcagcggcggaaagtctgggagagacttcactctcacgatcgatcgtctgcagcctggagattctgcaacttattactgtctccagcaccatgatttccctttcactttcggccctgggaccaaggtggaaatcaaacgt

SEQ ID NO: 332 - DNA, 339 bp, Artificial Sequence
  chemically synthesized
gatgttgtgatgactcagtctccactctccctgcccgtcacccctggagagccggcctccatctcctgcaggtctagtcagagcctcctgaatagtaatggatacaactatttggagtggtacctgcagaagccggggcagtctccacagctcctgatctatttgggttctaatcgggcctccggggtccctgacaggttcagtggcagtggatcaggcacagattttacactgaaaatcagcagagtggaggctgacgatgctggtgtttattactgcatgcagtctctacaaactcctctcactttcggcggtgggaccaagctggagatcaaacgt

SEQ ID NO: 333 - DNA, 330 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccccggatcaccttcggccaagggacacgactggagattaaacgt

SEQ ID NO: 334 - DNA, 330 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcctatgtacacttttggccaggggaccaagctggagatcaaacgt

SEQ ID NO: 335 - DNA, 324 bp, Artificial Sequence
  chemically synthesized
gatgttgtgatgactcagtctccagccaccctgtctgtgtctccaggggaaagagtcacactctcctgcagggccagtcagagtgttagagacaacgtaggttggtacaagcagaaacctggccaacctcccaggctcgtcatctatggtgcatccaccagggccactggtatcccagccaggatcagtggcagtgggtctgggacagagttcactctcaccatcagcagcctgcagtctgaagattttgcagtttattactgtcagcagtttaataattggccttacacttttggccaggggaccaagctggagatcaaacgt

SEQ ID NO: 336 - DNA, 324 bp, Artificial Sequence
  chemically synthesized
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatctatgctgcatccagtttgcacactggggtcccatcaaggttcagtggcagtggatctgggacagatttcactctcaccatcagcagtctgcaacctgaagattttgcaacttactactgtcaacagagttacagtattcctcgaacgttcggccaagggaccaaggtggaaatcaaacgt

SEQ ID NO: 337 - DNA, 327 bp, Artificial Sequence
  chemically synthesized
gatgttgtgatgactcagtctccagccaccctgtctgtgactccaggggaaagggccaccctctcctgcagggccagtcaaagtgttaacagcaacgtagcctggtaccagcagaaacctggccaggctcccaggctcctcatctatgatgtatccaccagggccactgatatcccagccaggttcagtggcagtgggtctgggacagacttcactctcaccatcagcagacttgaccctgaagattttgcagtgtattactgtcagcagtgtgctagctcacctcctgtcactttcggcggagggaccaagctggagatcaaacgt

SEQ ID NO: 338 - DNA, 330 bp, Artificial Sequence
  chemically synthesized
gaaattgtgatgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcgggtcactttcggcggagggaccaaagtggatatcaaacgt

SEQ ID NO: 339 - DNA, 327 bp, Artificial Sequence
  chemically synthesized
gatgttgtgatgactcagtctccaggcaccctgtctttgtctccaggggaaagagccaccctctcctgcagggccagtcagagtgttagcagcagcgccttagcctggttccagcagaaacctggccaggctcccaggctcctcatctatgattcatccagcagggccactggcatcccagacagcttcagcggcagtggatctgggacagaattcacactcacaatcagtagcctgcagcctgaagattttgcaacttattactgtcaacagtttaatacctaccccaacacttttggccaggggaccaagctggagatcaaacgt

SEQ ID NO: 340 - DNA, 336 bp, Artificial Sequence
  chemically synthesized
gacatccagatgacccagtctccactctccctgcccgtcacccctggagagccggcctccatctcctgcaggtctagtcagagcctcctgcatagtaatggatacaactatttggattggttcctgcagaagccagggcagtctccacggctcctgatctatatgggttctagtcgggcctccggggtccctgagaggttcagtggcagtggatcaggcacagattttacactgaaaatcagcagagtggaggctgaggatgttggggtctattactgcatgcaaactttacacactgtcactttcggcggcgggaccaaggtggaaatcaaacgt

SEQ ID NO: 341 - DNA, 324 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcctcttcggccaagggacacgactggagattaaacgt

SEQ ID NO: 342 - DNA, 327 bp, Artificial Sequence
  chemically synthesized
gacatccagttgacccagtctccatccttcctgtctgcatctgttggagacagagtcaccatcacttgccgggccagtcagggcattagcagttctttggcctggtatcagcaaaagccagggaaagcccctaagctcctgatctatgctgcatccactttgcaaagtggggtcccatcaaggttcagtggaagtggatctgggacagattttactttcaccatcagcagcctgcagcctgaagatattgcaacatattactgtcaacagtatgataatctccctcctctcactttcggcggagggaccaaggtggaaatcaaacgt

SEQ ID NO: 343 - DNA, 339 bp, Artificial Sequence
  chemically synthesized
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagatttcacagtgaaaatcagcagagtggaggctgaggatgttggggtttattactgcatgcaagctctacaaactccgtacacttttggccaggggaccaagctggagatcaaacgt

SEQ ID NO: 344 - DNA, 339 bp, Artificial Sequence
  chemically synthesized
gaaattgtgttgacgcagtctccactctccctgcccgtcacccttggacagccggcctccatctcctgcaggtcttgtcaaagcctcgtatacagtgatggcaacacctacttgaattgctttcagcagaggccaggccaatctccaaggcgcctaatttataaggtttctaaccgggactctggggtcccagacagattcagcggcagtgggtcaggcacagattttacactggaaatcagcagagtggaggctgaggatgttgggatttatttctgcatgcaaggtctacaaactccattcactttcggccctgggaccaaagtggatatcaaacgt

SEQ ID NO: 345 - DNA, 330 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctgcgctcactttcggcggagggaccaagctggagatcaaacgt

SEQ ID NO: 346 - DNA, 339 bp, Artificial Sequence
  chemically synthesized
gaaattgtgatgacgcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctactcgggcctccggggtccctgacaggttcagtggcagtggatcaggcacagactttacactgaaaatcagcagagcggaggctgaggatgttggggtttattactgcatgcaagctctacacactccgtggacgttcggcctagggaccaaagtggatatcaaacgt

SEQ ID NO: 347 - DNA, 327 bp, Artificial Sequence
  chemically synthesized
gacatccagatgacccagtctccagccaccctgtctgtgtctccaggggaaagggccaccctcttttgccgggccagtgaaggtcttaccaccaacttagcctggtaccagcacaaacctggccaggctcccaggctcctcatctatgctgcctccaccagggccactggtgtcccagccaggttcagtggcagtgggtctgggacagacttcactctcaccatcagcagcctgcagtctgaagattccgcagtttattactgtcagcagtataatcactggcctctctacacttttggccaggggaccaaggtggaaatcaaacgt

SEQ ID NO: 348 - DNA, 324 bp, Artificial Sequence
  chemically synthesized
gacatccagttgacccagtctccttccaccctgtctttgtctccaggggaaagagccaccctctcctgcagggccagtcagagtgttagcagctacttagcctggtaccaacagaaatctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagggtagcaactggccgctcactttcggcggagggaccaaggtggaaatcaaacgt

SEQ ID NO: 349 - DNA, 339 bp, Artificial Sequence
  chemically synthesized
gatattgtgatgacccacactccactctcctcacctgtcacccttggacagccggcctccatctcctgcaggtctagtcaaagcctcgaacacactgatggaaacacctacttaagttggcttcaccagaggccaggccagcccccaagactgttaatttataaggtttctacccggttctctggggtcccagacagattcagtggcagtggggcagggacagatttcacactgaaaatcagcagggtggaggctgaggatgtcggcgtttattactgcgtgcaggctacacactatcctcggacgttcggccatgggaccaaggtggagatcaaacgt

SEQ ID NO: 350 - DNA, 330 bp, Artificial Sequence
  chemically synthesized
gaaattgtgctgactcagtctccaggcaccctgtccttgtctccaggggaaagagccaccctctcctgcagggccagtcagagtattagcggcagttacttagcctggtaccagcagaaacgtggccaggctcccaggctcctcatctatgatgcgtccagcagggccgaaggcatcccagacaggttcattggcagtgggtctgggacagacttcactctcaccatcagcagactggagcctgaagactttgctatgtattactgtcagcagtatggtagctcaccaatattcactttcggccctgggaccaaagtggatatcaaacgt

SEQ ID NO: 351 - DNA, 339 bp, Artificial Sequence
  chemically synthesized
gaaattgtgctgactcagtctccagactccctgcccgtcacccctggagagccggcctccatctcctgcaggtctagtcagagcctcctgcatagtaatggaaacaactatttggattggtacctgcagaagccagggcagtctccacagctcctgatctatttgggttctaatcgggcctccggggtccctgacaggttcagtggcagtggatcaggcacagattttacactgaaactcagcagagtggaggctgaggatgttggggtttattactgcatgcaaggtctacaaatccctatcactttcggccctgggaccaaagtggatatcaaacgt

SEQ ID NO: 352 - DNA, 324 bp, Artificial Sequence
  chemically synthesized
gacatccagatgacccagtctccatcttctgtgtctgcatctgtgggagacagagtcaccatcacttgtcgggcgagtcagaacattcgccactggttagtctggtatcagcaaaaattagggcaagcccctaaactcctgatctatgctgcgtccaatttgcaaagtggggtcccgtcaaggttcagcggcagtggatctgggacagaattcactctcacaatcaacagcctgcaggctgaagattttgcaacctattactgtctacagcataacagttacccgtggacgttcggccaagggaccaaggtggaaatcaaacgt

SEQ ID NO: 353 - DNA, 324 bp, Artificial Sequence
  chemically synthesized
gaaattgtgttgacgcagtctccagactttcagtctgtgactccaaagcagaaagtcaccatcacctgccgggccagtcagagcattggtggtagcttacactggtaccagcagaaaccaggtcagtctccaaagctcatcatcaagtatgcttcccagtccttctcaggggtcccctcgaggttcagtggcagtggatctgggacagatttcaccctcaccatcgatagcctggaggctgaagatgctgcaacgtactattgtcatcagagtatcagtttaccgctcactttcggcggagggaccaaagtggatatcaaacgt

SEQ ID NO: 354 - DNA, 324 bp, Artificial Sequence
  chemically synthesized
gaaacgacactcacgcagtctccaggcaccctgtctttgtctccaggggaaggagccaccctctcctgcagggccagtcagagtgttaccagcaactacttagcctggtaccagcagaaacctggccaggctcccaggctcctcatctatggtgcatcctacagggccactggcatccctgacaggttcagcggcagtgggtctgggacagacttcactctcaccatcagcagactggagcctgaagattttgcagtgtattactgtcagcagtatgctagctcagtcaccttcggccaagggacacgactggagattaaacgt

SEQ ID NO: 355 - DNA, 324 bp, Artificial Sequence
  chemically synthesized
gatgttgtgatgactcagtctccagccaccctgtctgtgtctccaggggaaagagccaccctctcctgcagggccagtcagagtattagcagcaacttagcctggtaccagcagaaacctggccaggctcccaggctcctcatctatggtgcctccaccagggccactggtatcccagccaggttcagtggcagtgggtctgggacagagttcactctcaccatcagcagcctgcagtctgaagattttgcagtttattactgtcagcagtataataactggcctagaacgttcggccaagggaccaagctggagatcaaacgt

SEQ ID NO: 356 - DNA, 342 bp, Artificial Sequence
  chemically synthesized
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctgcccgggaatccggggtccctgaccgattcagtggcagcgggtctgggacagatttcactctcaccatcaacagcctgcaggctgaagatgtggcagtttattactgtcagcaattttatagtcctcctcggacgttcggccaagggaccaaggtggaaatcaaacgt

SEQ ID NO: 357 - DNA, 330 bp, Artificial Sequence
  chemically synthesized
gaaattgtgttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccccgggcactttcggcggagggaccaaagtggatatcaaacgt

SEQ ID NO: 358 - DNA, 327 bp, Artificial Sequence
  chemically synthesized
gaaattgtgctgactcagtctccaggcaccctgtctttgtctccaggggaaagagccaccctctcctgcagggccagtcagagtttaagtaccaacttagcctggtaccagcagaaacctggccaggctcccaggctcctcatctatggtgcatccaccagggccactggtatcccagccaggttcagtggcagtgggtctggcacagagttcactctcaccatcaccagcctgcagtctgaagattttgcagtttattactgtcagcagtatcataactggcctccgtacacttttggccaggggaccaaggtggagatcaaacgt

SEQ ID NO: 359 - DNA, 321 bp, Artificial Sequence
  chemically synthesized
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaacgt

SEQ ID NO: 360 - DNA, 327 bp, Artificial Sequence
  chemically synthesized
gaaacgacactcacgcagtctccaggcaccctgtctttgtctccaggggaaggcgccaccctctcctgcagggccagtcacagtgttggcgccaactacatagcctggtaccagcagaaacctggccaggctcccaggctccttatccatactgcatccaaaagggccactggcgtcccagagaggttcagtggcagtgggtctgggacagacttcactctcagtatcagcagactggagcctgaagactttgccgtgtatcactgtcagcagtatgctgccgcaccgattaccttcggccaagggacacgactggagattaaacgt

SEQ ID NO: 361 - DNA, 324 bp, Artificial Sequence
  chemically synthesized
gaaattgtgatgacacagtctccatcctccctgtctgcatctgtgggggacagagtcatcatcacttgccgggcgagtcagggcattgccaattatttagcctggtatcagcagaaaccagggaaaggtcctaaactcctgatctatgcttcatctactttgcaatcaggggtcccatctcggttcagtggcagtggatctgggacagatttcactctcaccatcagcggcctgcagcctgaagatgttgcaacttattactgtcagaagtataacagtgtccctctcactttcggcggagggaccaaagtggatatcaaacgt

SEQ ID NO: 362 - DNA, 342 bp, Artificial Sequence
  chemically synthesized
gatgttgtgatgactcagtctccagtctccctggctgtgtctctgggcgagagggccaccatcaactgcaagtccagccagagtgttttatacagaaccaacaataagaactacttggcttggtatcagcagaaaccaggacagcctcctaagttgctcatttactgggcatctacccgggaatccggggtccctgaccgattcagtggcagcgggtctgggacagatttcactctcaccatcagcagcctgcagcctgaggatgtggcagtgtactactgtcagcaatattacaatcttcctcgatcttttggccaggggaccaagctggagatcaaacgt

SEQ ID NO: 363 - DNA, 342 bp, Artificial Sequence
  chemically synthesized
gatattgtgatgacccacactccagactccctggctgtgtctctgggcgagagggccaccatcaactgcaagtccaaccggagtgttttatacagccccaacaatcagaactacttaggttggtaccagcagaagccaggacagcctcctaagctgctcatttactgggcatctacccgggactccggggcccctgaccgattcagtggcagcgggtctgggacagatttcactctcaccatcaacagcctgcaggctgaagatgtggcagtttattactgtcagcaatatgcaagtactccatacacttttggccaggggaccaaggtggagatcaaacgt

SEQ ID NO: 364 - DNA, 327 bp, Artificial Sequence
  chemically synthesized
gatgttgtgatgactcagtctccagccaccctgtctttgtctccaggggaaagagccaccctctcctgcagggccagtgagagtgttaatagcaacttcttagcctggtaccagcagaaacctggccaggctcccaggctcctcatctatgctgcatccaccagggccactggtatcccagccaggttcagtggcagtgggtctgggacagagttcactctcatcatcaccagcctgcagtctgaagattttgcagtttattactgtcagcagtataataactggccgctcactttcggcggagggaccaagctggagatcaaacgt

SEQ ID NO: 365 - DNA, 324 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggtcgctcactttcggcggagggaccaagctggagatcaaacgt

SEQ ID NO: 366 - DNA, 330 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccaacagaaacctggccaggctcccaggctcctcatctatggtgcttccaccagggccactggcatcccagacaggttcagtggcagtgggtctgggacggacttcactctcaccatcggcagactggagcctgaagattttgcagtgtattactgtcaacactatggtccctcacgtcggatcaccttcggccaagggacacgactggagattaaacgt

SEQ ID NO: 367 - DNA, 321 bp, Artificial Sequence
  chemically synthesized
gaaacgacactcacgcagtctccagacaccctgtctgtgtctccagggggaagagccaccctctcctgtagggccagtcagagcattgggagcaatttagcctggtaccaacagaaacctggccagtctcccaggctcctcatctatgatgcatccaccagggccacgggaatcccagccaggttcagtggcagtgggtctgggacagaattcactctcaccatcagcagcctggagtctgaagattttgtactttattactgtcagcagcatggtgaatggcccaccttcggccaagggacacgactggagattaaacgt

SEQ ID NO: 368 - DNA, 327 bp, Artificial Sequence
  chemically synthesized
gatgttgtgatgactcagtctccagccaccctgtctttgtctccaggggaaagagccaccctctcctgcagggccagtcagagtgtcggtaactccttagcctggtaccagcagaagcctggccaggctccccggctcctcatctatgatgcatccaacagggccactggcatcccagcccggttcagtggcagtgggtctgggacagacttcactctcaccatcaccagcctagagcctgaagattttgcaatttattactgtcaacaacgtggcacctggcctcccctcactttcggcggagggaccaagctggagatcaaacgt

SEQ ID NO: 369 - DNA, 324 bp, Artificial Sequence
  chemically synthesized
gatgttgtgatgactcagtctccatcctccctgtctgcatctgtaggagacacagtcaccatcacttgccgggccagtcagagtataactaactggttggcctggtatcagcagaaaccagggaaagcccccaagcgcctgatctatggtgcgtccagtttgcagagtggggtcccatcaaggttcagcggcagtggatctgggacagaattcactctcacaatcagcagcctgcagcctgaagattttgcaacttattactgtcaacagtatactaattaccctcgtacgttcggccaagggaccaagctggagatcaaacgt

SEQ ID NO: 370 - DNA, 321 bp, Artificial Sequence
  chemically synthesized
gacatccagatgacccagtctccttccaccctgtctgcatctgtaggagacagagtcaccatcacttgtcgggccaggcagagcatcagtaaccggttggcctggtatcagcagaaaccagggagagcccctaatgtcctgatctataaggcgtctactttagcaaatggggtcccatcaaggttcagcggcagtggatctgggacagaattcactctcaccatcagcagcctgcagcctgatgactttgcaacttattactgccaacagtatcaaagttactggacgttcggcccagggaccaaggtggaaatcaaacgt

SEQ ID NO: 371 - DNA, 324 bp, Artificial Sequence
  chemically synthesized
gacatccagttgacccagtctccagccaccctgtctttgtctccaggggaaagagccaccctctcctgcaaggccagtcagagtgttagtagctacttagcctggtaccaacagaaacttggccaggctcccaggctcctcatctatgatgcatccaacagggccactggcatcccagccaggttcagtgccagtgggtctgggacagacttcactctcaccatcagcagcctgcagcctgaagatgttgcaacttattactgtcaaaagtataacagtccccctcggacgttcggccaggggaccaaggtggaaatcaaacgt

SEQ ID NO: 372 - DNA, 327 bp, Artificial Sequence
  chemically synthesized
gaaacgacactcacgcagtctccaggcaccctgtctttgtctccaggggaaagggtcagcctttcctgcagggccagtcagaatgtttacagcaatttcttagcctggtatcaacagagacctggccaggctcccagtctcctcatctatggtgcctccagcagggccgctggcgtcccagacaggttcagtggcagtgggtctgggacagacttcgctctcaccatcagcagagtggagcctgaagattttgcagtctattactgtcaacaatatggaacctcaccgatcaccttcggccaagggacacgactggagattaaacgt

SEQ ID NO: 373 - DNA, 339 bp, Artificial Sequence
  chemically synthesized
gaaattgtgctgactcagtctccacgctcctcacccgtcacccttggacagccggcctccatctcctgtaggtctagtcaaagtctcgaacacggtgatggaaacacgtacttgagttggcttcagcagaggccaggccagcctccaagactcctgatttataaggtttctaaccggttgtctggggtcccagacagattcagtggcagtggggcagggactgatttcacactgaaaatcagcagggtggaagctgaggatgtcggggtttattactgcatgcaaggtatatactggcctcgaaccttcggccaagggacacgactggagattaaacgt

SEQ ID NO: 374 - DNA, 330 bp, Artificial Sequence
  chemically synthesized
gaaacgacactcacgcagtctccagtcaccctgtctttgtctccaggggacagagccaccctctcttgcagggccagtcagagtgttagcagcacctccttagcctggtaccagcacaaacctggccaggctcccaggctcctcatctatggtgcatccaggagggccactggcatcccagacaggttcagtggcagtgggtctgggacagacttcactctcaccatcaacagactggagcctgaagattttgcagtgtattactgtcagcactatggtagttcacctccaatcaccttcggccaagggacacgactggagattaaacgt

SEQ ID NO: 375 - DNA, 327 bp, Artificial Sequence
  chemically synthesized
gaaacgacactcacgcagtctccagccaccctgtctgtgtctccaggggaaagagccaccctctcctgcagggccagtcagagtgttggcagcaaattagcctggtaccagcagaaacctggccaggctcccaggctcctcatctatggtgcatccaccagggccactggtgtcccagtccggttcagtggcagtgggtctgggacagaattcactctcaccatcagcagcctgcagtctgaagattttgcagtttattactgtcagcagtataataactggcccccgatcaccttcggccaagggacacgactggagattaaacgt

SEQ ID NO: 376 - DNA, 339 bp, Artificial Sequence
  chemically synthesized
gaaattgtgttgacgcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtgtattactgcatgcaaactcttcaaactccgctcactttcggcggagggaccaaagtggatatcaaacgt

SEQ ID NO: 377 - DNA, 345 bp, Artificial Sequence
  chemically synthesized
gatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtactccgtacacttttggccaggggaccaagctggagatcaaacgt

SEQ ID NO: 378 - DNA, 339 bp, Artificial Sequence
  chemically synthesized
gatattgtgatgacccacactcccctctctctgtccgtcacccctggacagccggcctccatctcctgcaagtctagtcagagcctcctgggtggtgatggaaagacctatttgtattggtacctgcagaagccaggccagcctccacagctcctgctctatgaagtttccaaccgattctctggagtgccagataggttcagtggcagcggggcagcgacagatttcacactgaaaatcagcagggtggaagctgaggatgtcggggtttattactgcatgcaatctacacaatttccgtggacgttcggccaagggaccaaggtggagatcaaacgt

SEQ ID NO: 379 - DNA, 330 bp, Artificial Sequence
  chemically synthesized
gaaacgacactcacgcagtctccaggcaccctgtctttgtctgcaggggaaagagccaccctctcctgcagggccagtcagagtgttagcagcagctacttagcctggtaccagcagaaacctggccaggctcccaggctcctcatctatgctgcatcctacagggccactggcatcccagacaggttcagtggccgtgggtctgggacagagttcactctcaccatcagcagcctgcagtctgaagattttgcagtttattactgtcagcagtataataactggcctcccatcaccttcggccaagggacacgactggagattaaacgt

SEQ ID NO: 380 - DNA, 324 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccagccaggttcagtggcagtgggtctgggacagagttcactctcaccatcagcagcctgcagtctgaagattttgcagtttattactgtcagcactataataactggcctcataccttcggccaagggaccaagctggagatcaaacgt

SEQ ID NO: 381 - DNA, 324 bp, Artificial Sequence
  chemically synthesized
gaaacgacactcacgcagtctccaggcaccctgtctttgtctccaggggaaagagccaccctctcctgcagggccagtcagagtgttagcagcaactccttagcctggtaccagcagaaacctggccaggctcccaggctcctcatctatggtgcatccagcagggcctctggcatcccagacaggttcaatggcagtgggtctgggacagacttcactctcaccatcaataggctggagcctgaagactttgcagtgtattactgtcagcagtatggtaactcacagaccttcggccaagggacacgactggagattaaacgt

SEQ ID NO: 382 - DNA, 324 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccccggacgttcggccaagggaccaagctggagatcaaacgt

SEQ ID NO: 383 - DNA, 339 bp, Artificial Sequence
  chemically synthesized
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacattggcctcggactttcggcggagggaccaagctggagatcaaacgt

SEQ ID NO: 384 - DNA, 324 bp, Artificial Sequence
  chemically synthesized
gacatccagatgacccagtctccttccaccctgtctgcatctgtaggagacagagtcaccatcacttgccgggccagtcagagtattagtaggtggttggcctggtatcagcagaagccagggaaagcccctaagctcctgatctataaggcgtctactataaaaagtggggtcccatcaagattcagcgccagtggatctgggacagaattcactctcaccatcagcagcctgcagcctgaagattttgcaacttattactgccaacactataaaagtgattcccggacgttcggccaagggaccaaggtggaaatcaaacgt

SEQ ID NO: 385 - DNA, 321 bp, Artificial Sequence
  chemically synthesized
gatgttgtgatgactcagtctccatcctccctcgctgcatctgttggagacagaattaccatcacttgccggccaagtcaggacataggcacttatttaaattggtatcaacagaaggcaggggaagcccctaagctcctcatctatgctgcctccaatctgcacagtggcgtctcatcaaggttcagaggcgttgggtctgggacacaattcactctcaccatcagcagtctgcaacctgaggattttgcaacttactactgtcatcagagttacggtcctcggacattcggccaagggaccaagctggagatcaaacgt

SEQ ID NO: 386 - DNA, 327 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctccgatcaccttcggccaagggacacgactggagattaaacgt

SEQ ID NO: 387 - DNA, 327 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcagggtacacttttggccaggggaccaagctggagatcaaacgt

SEQ ID NO: 388 - DNA, 318 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcgttcggccaagggacacgactggagattaaacgt

SEQ ID NO: 389 - DNA, 324 bp, Artificial Sequence
  chemically synthesized
gaaattgtgttgacacagtctccttccaccctgtctgcatctgtaggggacagagtcaccatcacttgccgggccagtcagagtattagtagctgcttggcctggtatcagcagaaaccagggaaagcccctaagctcctgatctatgctgcatccactttgcaaagtggggtcccatcaaggttcagcggcagtggatctgggacagaattcactctcacaatcagcaccctgcagcctgaagattttgcaacttattactgtcaacagcttaatagttaccctcagacgttcggccaagggaccaaagtggatatcaaacgt

SEQ ID NO: 390 - DNA, 339 bp, Artificial Sequence
  chemically synthesized
gatattgtgatgacccacactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaacgt

SEQ ID NO: 391 - DNA, 327 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtataataactggcctctcactttcggcggagggaccaagctggagatcaaacgt

SEQ ID NO: 392 - DNA, 342 bp, Artificial Sequence
  chemically synthesized
gacatccagttgacccagtctcccgactccctggctgtgtctctgggcgagagggccaccatcaactgcacgtccagccagagtgttttatacagctccaacaataagaactacatagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattattatattcctcggacgttcggccaagggaccaaggtggaaatcaaacgt

SEQ ID NO: 393 - DNA, 336 bp, Artificial Sequence
  chemically synthesized
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcccccggggtccctgacaggttcagtggcagtggatcaggcacagattttacactgaaaatcagcagagtggaggctgaggatgttggggtttattactgcatgcaagctctacaaactcggacattcggccaagggaccaagctggagatcaaacgt

SEQ ID NO: 394 - DNA, 327 bp, Artificial Sequence
  chemically synthesized
gaaacgacactcacgcagtctccaggcaccctgtctttgtctccaggggaaagagccaccctctcctgcagggccagtcagagtcttaccagcagctacttagcctggtaccagcagaaacctggccaggctcccagactcctcatctatcgtgcatccagcagggccactggcatcccagaccggttcagtggcagtgggtctgggacagacttcactctcaccatcagcagactggagcctgaagattttgcagtttattactgtcagcagtatggtagttcacctaacaccttcggccaagggacacgactggagattaaacgt

SEQ ID NO: 395 - DNA, 342 bp, Artificial Sequence
  chemically synthesized
gaaattgtgttgacacagtctccactctccctgcccgtcacccttggacagccggcctccatctcctgcaggtctagtcaaagcctcgtacacagtaatggacacacctacttgagttggtttcagcagaggccaggccaatctccaaggcgcctcatttatgaggtttctaaccgggactctggtgtcccagacagattcagcggcagtgggtcaggcactgatttcacactaagaatcagcagggtggaggctgaggatgttggggtttattactgcttgcaaggaacacactggccccccctcactgtcggcggagggaccaaagtggatatcaaacgt

SEQ ID NO: 396 - DNA, 324 bp, Artificial Sequence
  chemically synthesized
gatgttgtgatgactcagtctccagccaccctgtctttgtctccaggggaaagagccaccctctcctgcagggccagtcagagtgttggcagcgacttagcctggtaccagcagaaacctggccaggctcccaggctcctcatctaccgtgcatccaccagggccgctggtatcccagccaggttcagtggcagtgggtctgggacagacttcactctcaccatcagcagactggagcctgaagattttgcagtgttttactgtcagcagtatggtagatcaccgtacacttctggccaggggaccaagctggagatcaaacgt

SEQ ID NO: 397 - DNA, 342 bp, Artificial Sequence
  chemically synthesized
gatattgtgatgacccacactccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaacgt

SEQ ID NO: 398 - DNA, 339 bp, Artificial Sequence
  chemically synthesized
gaaattgtgatgacgcagtctccactctccctgtccgtcacccctggagagccggcctccatctcctgcaggtctagtcagagcctcctacatagtagtggatacaactatttggattggtacctgcagaagccaggccagtctccacagctcctgatctatttgggttctactcgggcctccggggtccctgacaggttcagtggcagtggatcaggcacagattttacactgaaaatcagcagagtggaggctgaggatgttggggtttattattgcatgcaaggtctacaaattccgctcactttcggcggagggaccaaagtggatatcaaacgt

SEQ ID NO: 399 - DNA, 339 bp, Artificial Sequence
  chemically synthesized
gatattgtgatgacccacactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtggacgttcggccaagggaccaaggtggagatcaaacgt

SEQ ID NO: 400 - DNA, 321 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctcggttcggccaagggacacgactggagattaaacgt

SEQ ID NO: 401 - DNA, 324 bp, Artificial Sequence
  chemically synthesized
gatgttgtgatgactcagtctccttccaccctgtctgcatctgtaggggacagagtcaccatcacttgccgggccagtcagactattaatagttggttggcctggtatcagcagaaaccagggaaggcccctaagctcctcatctctagggcgtctcgtttagaaagtggggtcccatcaaggttcagcggcagtgcatctggcacagaatacattctcaccatcaacagcctgcagcctgatgattttgcaatgtacttctgccatcaatataatagttattctcccacttttggccaggggaccaagctggagatcaaacgt

SEQ ID NO: 402 - DNA, 327 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagccaggttcagtggcagtgggtctgggacagacttcactctcaccatcagcagcctagagcctgaagattttgcagtttattactgtcagcagcgttacaactggcctatcaccttcggccaagggacacgactggagattaaacgt

SEQ ID NO: 403 - DNA, 324 bp, Artificial Sequence
  chemically synthesized
gaaattgtgttgacgcagtctccagccaccctgtctttgtctccgggggaaacagccaccctctcctgcagggccagtcagactattggtcccaagtccttcggctggtaccaacagagacctggccaggctcccaggctcctcatctatgactccaacagggccactggcatcccagccaggttcagtggcagtgggtctgggacagacttcactctcaccatcagcagcctagagcctgaagattttgcagtttattactgtcagcagcgtagcaggtggcctctcactttcggccctgggaccaaagtggatatcaaacgt

SEQ ID NO: 404 - DNA, 339 bp, Artificial Sequence
  chemically synthesized
gatgttgtgatgactcagtctccactctccctgcccgtcacccttggacagccggcctccatctcctgcaggtctagtcaaagcctcgtgtacagtgatggaaacacctacttgtattggtttcagcagagggcaggccaatctccaaggcgcctgatttataaggtttctaagcgggactctggggtcccagacaggttcagcggcagtgggtcaggcactgatttcacactgaaaatcagcagggtggaggctgaggatgttggaatttattactgcgtgcaaggtagacactggccgtacactcttggccaggggaccaagctggagatcaaacgt

SEQ ID NO: 405 - DNA, 327 bp, Artificial Sequence
  chemically synthesized
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccaacagggccactggcatcccagccaggttcagtggcagtggatctgggacagaattcactctcaccatcagcagcctgcagcctgatgattttgcaacttattactgccaacagtataatagttattcaaggacgttcggccaggggaccaaagtggatatcaaacgt

SEQ ID NO: 406 - DNA, 324 bp, Artificial Sequence
  chemically synthesized
gatgttgtgatgactcagtctccttccaccctgtctgcatctgtgggagacagagtcaccatcacttgccgggccagtcagagtattactacctggttggcctggtctcagcagcaaccagggaaagcccctaagctcctcatctataaggcctctagtttaacaagtggggtcccatcaaggttcagcggcagtggatctgggacagagttcactctcaccatcagcagcctgcagcctgatgattttgcaagttattactgccatcattataatggtgcttctcgtatgttcggccaagggaccaagctggagatcaaacgt

SEQ ID NO: 407 - DNA, 321 bp, Artificial Sequence
  chemically synthesized
gaaacgacactcacgcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctttcttcggccaagggacacgactggagattaaacgt

SEQ ID NO: 408 - DNA, 324 bp, Artificial Sequence
  chemically synthesized
gaaacgacactcacgcagtctccagccaccctgactttgtctccaggggaaagagtcaccctctcctgcagggccagtcagagtattggcacttacgtcgcctggtatcagcagaaacctggccaggctcccagattcctcatctatgattcatcgaatagggccactggcatcccagccaggttcagtggtagtgggtctgggacagacttcactctcacgatcagcagcctggagcctgaagattttgcattttattactgtcaacagcgtgccgagtggcctctcaccttcggccaagggacacgactggagattaaacgt

SEQ ID NO: 409 - DNA, 330 bp, Artificial Sequence
  chemically synthesized
gatgttgtgatgactcagtctccaggcaccctgtctttgtctccaggggaaagagccactctctcctgcagggccagtcagagtgttaatagcggctacttagcctggtaccagcagaaacctggccaacctcccagactcctcatctctggtgtttccaccagggccactggcatcccagacaggttcagtggcagtgggtctgggacagacttcactctcaccatcagcagactggagcctgaagattttgcagtgtattactgtcaggagtatggtaactcagctatgtacaattttggccaggggaccaagctggagatcaaacgt

SEQ ID NO: 410 - DNA, 327 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcccttcaccttcggccaagggacacgactggagattaaacgt

SEQ ID NO: 411 - DNA, 327 bp, Artificial Sequence
  chemically synthesized
gatgttgtgatgactcagtctccaggcaccctgtctttgtctccaggggaaagagccaccctctcctgcagggccagtcagagtgttagcagcagctacttaggctggtatcagcagaaatccggccaggctcccaggctcctcatctatggtgcatccagcagggccactgacatcccagacaggttcagtggcagtgggtctgggacagacttcactctcaccatcagcaaactggaggcagaagattctgcagtgtattactgtcagcagtatggtatctcacctctcgcgttcggccaagggaccaagctggagatcaaacgt

SEQ ID NO: 412 - DNA, 327 bp, Artificial Sequence
  chemically synthesized
gaaacgacactcacgcagtctccagccaccctgtctgtgtctccaggggagagagccaccctctcctgcagggccagtcagagtattagcaacaacttagcctggtaccagcagaaacctggccaggctcccaggctcctcatctatggtacatccaccagggccactggtatcccagccaggttcagtggcagtgggtctgggacagagttcactctcaccatcagcagcctgcagtctgaagattttgcagtttattactgtcagcagtataatttctggccttcgatcaccttcggccaagggacacgactggagattaaacgt

SEQ ID NO: 413 - DNA, 324 bp, Artificial Sequence
  chemically synthesized
gaaacgacactcacgcagtctccaggcaccctgtctttgtctccaggggaaagagccaccctctcctgcagggccagtcagagtgttagcagcagctccttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacagaccttcggccaagggacacgactggagattaaacgt

SEQ ID NO: 414 - DNA, 339 bp, Artificial Sequence
  chemically synthesized
gatgttgtgatgactcagtctccactctccctgcccgtctcccttggacagccggcctccatctcctgcaggtctaatcaaagcctcgtatacagtgatggaggcacctacttgaattggtttcagcagagggcaggccagtctccaaggcgcctagtttataaggtttctaaccgggactctggggtcccagacagattcagcggcagtgggtcaggcactgatttcacactgagaatcagcagggtggaggctgaggatgttggggtttattactgcatgcaagggacacactggccgtacacttttggccaggggaccaagctggagatcaaacgt

SEQ ID NO: 415 - DNA, 324 bp, Artificial Sequence
  chemically synthesized
gacatccagttgacccagtctccatcctccctgtctgcatctgtaggagacagagtcaccgtcacttgccgggcaagtcagagcattagcagctatttaaattggtatcagcagaaaccagggaaagcccctcaactcctgatctacgatgcatccaatttggaaacaggggtcccctcaaggttcagtggaagtggatctgggacagattttactttcaccatcagcagcctgcagcctgaagattttgcaacatattactgtcagcagtttgataatgtcccagtcactttcggcggagggaccaaggtggaaatcaaacgt

SEQ ID NO: 416 - DNA, 339 bp, Artificial Sequence
  chemically synthesized
gaaattgtgctgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcgaacgttcggccaagggaccaagctggagatcaaacgt

SEQ ID NO: 417 - DNA, 327 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtagctcatccatgtacacttttggccaggggaccaagctggagatcaaacgt

SEQ ID NO: 418 - DNA, 324 bp, Artificial Sequence
  chemically synthesized
gatgttgtgatgactcagtctccatcctccctgtctgcatctgtgggggacagcgtcgccatcacttgccgggcaagtcagagcattagcaactatttaaattggtatcagcagagaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactcctgtcaacagagttacattaccccgtggacgttcggccaagggaccaagctggagatcaaacgt

SEQ ID NO: 419 - DNA, 324 bp, Artificial Sequence
  chemically synthesized
gatgttgtgatgactcagtctccaggcaccctgtctttgtctccaggggaaagagccaccctctcctgcagggccagtcagagtgttagcaccctcttagcctggtaccaacagaaacctggccaggctcccaggctcctcatctatgatgcatccaacagggccactggcatcccaggcaggttcagtgccagtgggtctgggacagacttcagtctcaccatcagcagcctagagactgaagattctgcagtttattactgtcagcaccgttacgtgtggccgttcactttcggcggagggaccaagctggagatcaaacgt

SEQ ID NO: 420 - DNA, 324 bp, Artificial Sequence
  chemically synthesized
gacatccagatgacccagtctccatcctccctgtctgcatctgtaggagacagagtcaccatcacttgccgggcaagtcagggcattagaaatgatttaggctggtatcagcagaaaccagggaaagcccctaagcgtctgatctatggtgcatccagtttgcaaagtggagtcccatcaaggttcagcggcagtggatctgggacagaattcactctcacaatcaggagcctgcagcctgaagattttgcaacttattattgtctacagcataattcctaccctcgaacattcggccaagggaccaaggtggaaatcaaacgt

SEQ ID NO: 421 - DNA, 324 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgtggacgttcggccaagggaccaagctggagatcaaacgt

SEQ ID NO: 422 - DNA, 339 bp, Artificial Sequence
  chemically synthesized
gatgttgtgatgactcagtctccgctctccctgcccgtcacccttggacaggcggcctccatctcctgcaggtctagtcatagcctcacaactactgatggacgtacttacgtggcttggtttcagcagaggccaggccaatctccaaggcgccttctttatgaggtttctaagcgggactctggggccccagacagattcagcggcagtgggtcaggcactgatttcactctgaaaatcagcagggtggaggctgacgatgttggaatttatcattgcatgcaaggaacacatgggcctcacacgttcggccaagggaccaagctggagatcaaacgt

SEQ ID NO: 423 - DNA, 327 bp, Artificial Sequence
  chemically synthesized
gaaacgacactcacgcagtctccagccaccctgtctgtgtctccaggggaaagagccaccctctcctgcagggccagtcaaagtgttaccagcaacttagcctggtaccagcagaaacctggccaggctcccaggctcctcatctatggtgcatccaacagggccactggtatcccagccaggttcagtgtcagtgggtctgggacagacttcactctcaccatcagcagactggagcctgaagattttgcagtgtattactgtcagcagtatggtagtccacctccgaccaccttcggccaagggacacgactggagattaaacgt

SEQ ID NO: 424 - DNA, 327 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgtcggacgttcggccaagggaccaagctggagatcaaacgt

SEQ ID NO: 425 - DNA, 327 bp, Artificial Sequence
  chemically synthesized
gaaacgacactcacgcagtctccaggcaccctgtccttgtctccaggggaaagagccaccctctcctgcagggccagtcagagtgttttcaacaactacttagcctggtaccaacagagacctggccaggctcccaggctcctcatctatggtgcatccagcagggccactggcatcccagacaggttcagtggcggtgggtctgggacagacttcactctcaccatcagcagactggagcctgaagatttcgcagtgtattgctgtcagcagtatggtagttcaccgatcaccttcggccaagggacacgactggagattaaacgt

SEQ ID NO: 426 - DNA, 327 bp, Artificial Sequence
  chemically synthesized
gaaattgtgctgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagactggagcctgaagattttgcagtgtattactgtcagcagtatggtagctcactcaggtacacttttggccaggggaccaagctggagatcaaacgt

SEQ ID NO: 427 - DNA, 339 bp, Artificial Sequence
  chemically synthesized
gaaattgtgctgactcagtctccagactccctggctgtgtctctgggcgagagggccaccatcaactgcaagtccagccagagtgttttatatgattccaacagtaagaactacttaagttggtatcagcagaaaccaggccagcctcctaagttgctcatttcctgggcgtctacccgggggtccggggtccctgaccgattcagtggcagcgggtctgggacagatttcactctcaccatcagcagcctgcaggctgaagatgtggcagtttattactgtcagcaattttatggtattccccacttcggccaagggacacgactggagattaaacgt

SEQ ID NO: 428 - DNA, 327 bp, Artificial Sequence
  chemically synthesized
gatgttgtgatgactcagtctccagccaccctgtctttgtctccaggggaaagagccaccctctcctgcagggccagtcagagtgttggtaccaatttagcctggtaccagcagaaacctggccaggctcccaggctcctcatctatgatgcatccaacagggccactggcatcccagccaggttcagtggcagtgggtctgggacagagttcactctcaccatcagcagcctgcagtctgaagattttgcagtttattactgtcagcagtataataactggcctccgataactttcggcggagggaccaagctggagatcaaacgt

SEQ ID NO: 429 - DNA, 339 bp, Artificial Sequence
  chemically synthesized
gatgttgtgatgactcagtctccactctccctgcccgtcacccttggacagccggcctccatctcctgcaggtctagtcaaagcctcgtatacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaaggtacacaatttcctcaaacgttcggccaagggaccaagctggagatcaaacgt

SEQ ID NO: 430 - DNA, 330 bp, Artificial Sequence
  chemically synthesized
gaaattgtgctgactcagtctccaggcaccctgtctttgtctccaggggaaagagccaccctctcctgcagggccagtcagagtgtaataagcaggtacttagcctggtatcagcagaaacctggccaggctcccaggctcctcatccatggtgcatccaccagggccactggcatcccagacaggttcagtggcagtgggtctgggacagacttcactctcaccatcagcagactggagcctgaagactttgcagtgtattactgtcagcagtatggtagctcacctccgtacacttttggccaggggaccaaggtggaaatcaaacgt

SEQ ID NO: 431 - DNA, 324 bp, Artificial Sequence
  chemically synthesized
gacatccagttgacccagtctccttccaccctggctgcatctgtaggagacagagtcaccatcacttgccgggccagtcagagtattagtagctggttggcctggtatcagcagaaaccagggaaagcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataatagttattcggggacgttcggccaagggaccaaggtggaaatcaaacgt

SEQ ID NO: 432 - DNA, 324 bp, Artificial Sequence
  chemically synthesized
gatgttgtgatgactcagtctccagccatcctgtctgtgtctccaggggaaagagccaccctctcctgcagggccagtcagagtgttagtagcagcttagcctggtaccagcagaaacctggccagcctcccaggctcctcatctatggtgcctccaccagggccactgctatcccagccaggttcagtggcagtgggtctgggacagagttcactctcaccatcagcagcctgcagtctgaagattttgcagtttattactgtcagcgctatgataactggcctcccctttttggccaggggaccaagctggagatcaaacgt

SEQ ID NO: 433 - protein, 10 aa, Artificial Sequence
  chemically synthesized
GYTFTSYAMH

SEQ ID NO: 434 - protein, 10 aa, Artificial Sequence
  chemically synthesized
GFTFSSYSMN

SEQ ID NO: 435 - protein, 10 aa, Artificial Sequence
  chemically synthesized
GYTFTSYYMH

SEQ ID NO: 436 - protein, 10 aa, Artificial Sequence
  chemically synthesized
GFTFSDPYMD

SEQ ID NO: 437 - protein, 10 aa, Artificial Sequence
  chemically synthesized
GFTFSSYAMH

SEQ ID NO: 438 - protein, 10 aa, Artificial Sequence
  chemically synthesized
GFTFSNAWMS

SEQ ID NO: 439 - protein, 10 aa, Artificial Sequence
  chemically synthesized
GGSFSGYYWS

SEQ ID NO: 440 - protein, 12 aa, Artificial Sequence
  chemically synthesized
GDSVSSNSVTWN

SEQ ID NO: 441 - protein, 10 aa, Artificial Sequence
  chemically synthesized
GYTFAAYYLH

SEQ ID NO: 442 - protein, 10 aa, Artificial Sequence
  chemically synthesized
GFTFSSHLMH

SEQ ID NO: 443 - protein, 12 aa, Artificial Sequence
  chemically synthesized
GGSISSGGYSWS

SEQ ID NO: 444 - protein, 12 aa, Artificial Sequence
  chemically synthesized
GDSVSNNRAAWN

SEQ ID NO: 445 - protein, 10 aa, Artificial Sequence
  chemically synthesized
GYTFTSYGIS

SEQ ID NO: 446 - protein, 10 aa, Artificial Sequence
  chemically synthesized
GYSFTSYWIG

SEQ ID NO: 447 - protein, 10 aa, Artificial Sequence
  chemically synthesized
GYSFTSYWIA

SEQ ID NO: 448 - protein, 10 aa, Artificial Sequence
  chemically synthesized
GFTFTDAWMN

SEQ ID NO: 449 - protein, 10 aa, Artificial Sequence
  chemically synthesized
GFTFSNNWMT

SEQ ID NO: 450 - protein, 10 aa, Artificial Sequence
  chemically synthesized
GFTFSSYGMH

SEQ ID NO: 451 - protein, 10 aa, Artificial Sequence
  chemically synthesized
GFTFDDYAMH

SEQ ID NO: 452 - protein, 10 aa, Artificial Sequence
  chemically synthesized
GFTFSNYVMS

SEQ ID NO: 453 - protein, 10 aa, Artificial Sequence
  chemically synthesized
GFTFSSYAMS

SEQ ID NO: 454 - protein, 10 aa, Artificial Sequence
  chemically synthesized
GYTFTSYDIN

SEQ ID NO: 455 - protein, 10 aa, Artificial Sequence
  chemically synthesized
GYTFTDYAIH

SEQ ID NO: 456 - protein, 10 aa, Artificial Sequence
  chemically synthesized
GFTVSSNYMS

SEQ ID NO: 457 - protein, 10 aa, Artificial Sequence
  chemically synthesized
GGTFSSYAIS

SEQ ID NO: 458 - protein, 10 aa, Artificial Sequence
  chemically synthesized
GFTFSSYAIS

SEQ ID NO: 459 - protein, 10 aa, Artificial Sequence
  chemically synthesized
GFTFSSYAIH

SEQ ID NO: 460 - protein, 10 aa, Artificial Sequence
  chemically synthesized
GYTFTSSDIN

SEQ ID NO: 461 - protein, 12 aa, Artificial Sequence
  chemically synthesized
GDSVSSNSAAWN

SEQ ID NO: 462 - protein, 12 aa, Artificial Sequence
  chemically synthesized
GDSVSSNNAAWN

SEQ ID NO: 463 - protein, 12 aa, Artificial Sequence
  chemically synthesized
GFSLSTSGVGVG

SEQ ID NO: 464 - protein, 10 aa, Artificial Sequence
  chemically synthesized
GGSISSYYWS

SEQ ID NO: 465 - protein, 10 aa, Artificial Sequence
  chemically synthesized
GFTFSSSAMH

SEQ ID NO: 466 - protein, 12 aa, Artificial Sequence
  chemically synthesized
GDSVSSDSAVWT

SEQ ID NO: 467 - protein, 10 aa, Artificial Sequence
  chemically synthesized
GFTFSTYPMH

SEQ ID NO: 468 - protein, 10 aa, Artificial Sequence
  chemically synthesized
GFTFAAYNIN

SEQ ID NO: 469 - protein, 10 aa, Artificial Sequence
  chemically synthesized
GFTFSSYGMT

SEQ ID NO: 470 - protein, 10 aa, Artificial Sequence
  chemically synthesized
GYTFTGYYMH

SEQ ID NO: 471 - protein, 10 aa, Artificial Sequence
  chemically synthesized
GYTLTELSMH

SEQ ID NO: 472 - protein, 10 aa, Artificial Sequence
  chemically synthesized
GFTFSDQYMD

SEQ ID NO: 473 - protein, 10 aa, Artificial Sequence
  chemically synthesized
GFTFGDYAMS

SEQ ID NO: 474 - protein, 10 aa, Artificial Sequence
  chemically synthesized
GFNFSGYEMN

SEQ ID NO: 475 - protein, 10 aa, Artificial Sequence
  chemically synthesized
RFTFSDAWMS

SEQ ID NO: 476 - protein, 10 aa, Artificial Sequence
  chemically synthesized
GFTFSTYGMH

SEQ ID NO: 477 - protein, 10 aa, Artificial Sequence
  chemically synthesized
GISFRDYWMH

SEQ ID NO: 478 - protein, 12 aa, Artificial Sequence
  chemically synthesized
GDSVSSKSAAWN

SEQ ID NO: 479 - protein, 12 aa, Artificial Sequence
  chemically synthesized
GDSVSSGSAAWN

SEQ ID NO: 480 - protein, 10 aa, Artificial Sequence
  chemically synthesized
EFTLRNYGVS

SEQ ID NO: 481 - protein, 10 aa, Artificial Sequence
  chemically synthesized
GGSVSGYYWS

SEQ ID NO: 482 - protein, 12 aa, Artificial Sequence
  chemically synthesized
GDSVSSNTATWN

SEQ ID NO: 483 - protein, 12 aa, Artificial Sequence
  chemically synthesized
GDSVSGNSAAWN

SEQ ID NO: 484 - protein, 10 aa, Artificial Sequence
  chemically synthesized
GYTFTSYAIS

SEQ ID NO: 485 - protein, 10 aa, Artificial Sequence
  chemically synthesized
GFIFSNYAIH

SEQ ID NO: 486 - protein, 17 aa, Artificial Sequence
  chemically synthesized
WINAGNGNTKYSQKFQG

SEQ ID NO: 487 - protein, 17 aa, Artificial Sequence
  chemically synthesized
IISDDGSKSYYADSVQG

SEQ ID NO: 488 - protein, 17 aa, Artificial Sequence
  chemically synthesized
IINPSGGSTSYAQKFQG

SEQ ID NO: 489 - protein, 19 aa, Artificial Sequence
  chemically synthesized
RITNKRTGYATTYAASVKD

SEQ ID NO: 490 - protein, 17 aa, Artificial Sequence
  chemically synthesized
WINAGNGNTKYSQKFQG

SEQ ID NO: 491 - protein, 19 aa, Artificial Sequence
  chemically synthesized
RIKSKTDGGTTDYAAPVKG

SEQ ID NO: 492 - protein, 16 aa, Artificial Sequence
  chemically synthesized
EINHSGSTNYNPSLKS

SEQ ID NO: 493 - protein, 18 aa, Artificial Sequence
  chemically synthesized
RTYYRSQWYYNYAVSVKS

SEQ ID NO: 494 - protein, 19 aa, Artificial Sequence
  chemically synthesized
RIKSKTDGETTDYAAPVKG

SEQ ID NO: 495 - protein, 19 aa, Artificial Sequence
  chemically synthesized
FIRSKAYGGTTEYAASVKG

SEQ ID NO: 496 - protein, 17 aa, Artificial Sequence
  chemically synthesized
RISPGNGVTSYAQKFQG

SEQ ID NO: 497 - protein, 17 aa, Artificial Sequence
  chemically synthesized
VISYDGTSKYYGDSVKG

SEQ ID NO: 498 - protein, 16 aa, Artificial Sequence
  chemically synthesized
YIYHSGSTYYNPSLKS

SEQ ID NO: 499 - protein, 17 aa, Artificial Sequence
  chemically synthesized
YISSSGSYTNYADSVKG

SEQ ID NO: 500 - protein, 17 aa, Artificial Sequence
  chemically synthesized
WISAYNGNTNYAQKLQG

SEQ ID NO: 501 - protein, 17 aa, Artificial Sequence
  chemically synthesized
IIYPGDSDTRYSPSFQG

SEQ ID NO: 502 - protein, 17 aa, Artificial Sequence
  chemically synthesized
WIIPIFGIANYAQKFQG

SEQ ID NO: 503 - protein, 17 aa, Artificial Sequence
  chemically synthesized
VIYPGDSDTRYSPSFQG

SEQ ID NO: 504 - protein, 19 aa, Artificial Sequence
  chemically synthesized
RVKNKADGETTDYAAPVKG

SEQ ID NO: 505 - protein, 17 aa, Artificial Sequence
  chemically synthesized
NIKQDGTEKHYVDSVKG

SEQ ID NO: 506 - protein, 17 aa, Artificial Sequence
  chemically synthesized
VISYDGSNKYYADSVKG

SEQ ID NO: 507 - protein, 17 aa, Artificial Sequence
  chemically synthesized
AISGSGGSTYYADSVKG

SEQ ID NO: 508 - protein, 17 aa, Artificial Sequence
  chemically synthesized
YISSTSSTIYYADSVKG

SEQ ID NO: 509 - protein, 17 aa, Artificial Sequence
  chemically synthesized
AISGIGDTTYYADSVKG

SEQ ID NO: 510 - protein, 17 aa, Artificial Sequence
  chemically synthesized
WMNPNSGNTGYAQKFQG

SEQ ID NO: 511 - protein, 17 aa, Artificial Sequence
  chemically synthesized
WINAGDGGTKSSREFQG

SEQ ID NO: 512 - protein, 16 aa, Artificial Sequence
  chemically synthesized
VIYSGGSTYYADSVKG

SEQ ID NO: 513 - protein, 17 aa, Artificial Sequence
  chemically synthesized
GIIPIFGTANYAQKFQG

SEQ ID NO: 514 - protein, 17 aa, Artificial Sequence
  chemically synthesized
GIIPMYGTANYAQKFQG

SEQ ID NO: 515 - protein, 17 aa, Artificial Sequence
  chemically synthesized
WMNPNSGNTGYAEKFQG

SEQ ID NO: 516 - protein, 18 aa, Artificial Sequence
  chemically synthesized
RTYYRSKWYNDYAVSVKS

SEQ ID NO: 517 - protein, 18 aa, Artificial Sequence
  chemically synthesized
RTFYRSKWYNDYAVSVKS

SEQ ID NO: 518 - protein, 16 aa, Artificial Sequence
  chemically synthesized
LIYWDDDKRYSPSLKS

SEQ ID NO: 519 - protein, 16 aa, Artificial Sequence
  chemically synthesized
YIYYTGSTNYNPSLKS

SEQ ID NO: 520 - protein, 17 aa, Artificial Sequence
  chemically synthesized
MIWHDESKKYYADSVKG

SEQ ID NO: 521 - protein, 18 aa, Artificial Sequence
  chemically synthesized
RTYYKSKWYNDYAASVKS

SEQ ID NO: 522 - protein, 17 aa, Artificial Sequence
  chemically synthesized
VISYDGRNEYYADSVKG

SEQ ID NO: 523 - protein, 17 aa, Artificial Sequence
  chemically synthesized
FISYDGSNKYYADSVKG

SEQ ID NO: 524 - protein, 19 aa, Artificial Sequence
  chemically synthesized
FIRANADSGTTEYAASVKG

SEQ ID NO: 525 - protein, 17 aa, Artificial Sequence
  chemically synthesized
TISGNGVGTYYPDSVKD

SEQ ID NO: 526 - protein, 17 aa, Artificial Sequence
  chemically synthesized
WINPNSGGTNYAQKFQG

SEQ ID NO: 527 - protein, 17 aa, Artificial Sequence
  chemically synthesized
GFDPEDGETIYAQKFQG

SEQ ID NO: 528 - protein, 19 aa, Artificial Sequence
  chemically synthesized
RVRNKANSYTTEYAASVKG

SEQ ID NO: 529 - protein, 17 aa, Artificial Sequence
  chemically synthesized
AISSNGGSTYYADSVKG

SEQ ID NO: 530 - protein, 17 aa, Artificial Sequence
  chemically synthesized
YVSTSGSTRYYADSVKG

SEQ ID NO: 531 - protein, 17 aa, Artificial Sequence
  chemically synthesized
GISGSGGSTYYADSVKG

SEQ ID NO: 532 - protein, 19 aa, Artificial Sequence
  chemically synthesized
RIKSKISGGTTDYAAPVQG

SEQ ID NO: 533 - protein, 18 aa, Artificial Sequence
  chemically synthesized
RTYYRSKWYNDYAVSLKS

SEQ ID NO: 534 - protein, 17 aa, Artificial Sequence
  chemically synthesized
LISYDGSKKYYANSVKG

SEQ ID NO: 535 - protein, 17 aa, Artificial Sequence
  chemically synthesized
WINAGNGNTKYSEKFEG

SEQ ID NO: 536 - protein, 17 aa, Artificial Sequence
  chemically synthesized
RINPDGSSTSYADSVKG

SEQ ID NO: 537 - protein, 18 aa, Artificial Sequence
  chemically synthesized
RTYYRSKWNNDYALSVKS

SEQ ID NO: 538 - protein, 18 aa, Artificial Sequence
  chemically synthesized
RTYYRAKWYNEYAGSVKS

SEQ ID NO: 539 - protein, 17 aa, Artificial Sequence
  chemically synthesized
GMSGSGYSTYYADSVKG

SEQ ID NO: 540 - protein, 16 aa, Artificial Sequence
  chemically synthesized
EIHHSGSTNYNPSLKS

SEQ ID NO: 541 - protein, 18 aa, Artificial Sequence
  chemically synthesized
RTYYRSKWYKDNALSVKS

SEQ ID NO: 542 - protein, 16 aa, Artificial Sequence
  chemically synthesized
LIYSDGRTNYADSVKG

SEQ ID NO: 543 - protein, 17 aa, Artificial Sequence
  chemically synthesized
AISSNGGSTYYANSVKG

SEQ ID NO: 544 - protein, 17 aa, Artificial Sequence
  chemically synthesized
WISAYDGNTNYAQKLQG

SEQ ID NO: 545 - protein, 17 aa, Artificial Sequence
  chemically synthesized
YISSSGTTIYYADSVKG

SEQ ID NO: 546 - protein, 17 aa, Artificial Sequence
  chemically synthesized
VIWYDGSNKYYADSVKG

SEQ ID NO: 547 - protein, 15 aa, Artificial Sequence
  chemically synthesized
GSLSRSGWYAGLFDY

SEQ ID NO: 548 - protein, 15 aa, Artificial Sequence
  chemically synthesized
DRGTKWNQLNDVFDM

SEQ ID NO: 549 - protein, 14 aa, Artificial Sequence
  chemically synthesized
GRGYSSSRLYYFDY

SEQ ID NO: 550 - protein, 9 aa, Artificial Sequence
  chemically synthesized
DVSGSFAAY

SEQ ID NO: 551 - protein, 10 aa, Artificial Sequence
  chemically synthesized
EGGAVAGTVY

SEQ ID NO: 552 - protein, 5 aa, Artificial Sequence
  chemically synthesized
DEYFY

SEQ ID NO: 553 - protein, 15 aa, Artificial Sequence
  chemically synthesized
VNPGSYTREVSNFDY

SEQ ID NO: 554 - protein, 9 aa, Artificial Sequence
  chemically synthesized
RGHNYGVDY

SEQ ID NO: 555 - protein, 9 aa, Artificial Sequence
  chemically synthesized
GVGWSPFQY

SEQ ID NO: 556 - protein, 16 aa, Artificial Sequence
  chemically synthesized
DDKIAAAGFTYWYFDL

SEQ ID NO: 557 - protein, 9 aa, Artificial Sequence
  chemically synthesized
EAADDPFDH

SEQ ID NO: 558 - protein, 6 aa, Artificial Sequence
  chemically synthesized
ADYKYD

SEQ ID NO: 559 - protein, 14 aa, Artificial Sequence
  chemically synthesized
HRRPIYDILTGFDY

SEQ ID NO: 560 - protein, 10 aa, Artificial Sequence
  chemically synthesized
EDTMVRGVIP

SEQ ID NO: 561 - protein, 18 aa, Artificial Sequence
  chemically synthesized
DRRYYDSSGYYPAYYFDY

SEQ ID NO: 562 - protein, 13 aa, Artificial Sequence
  chemically synthesized
DGGYDSSGFHFDY

SEQ ID NO: 563 - protein, 17 aa, Artificial Sequence
  chemically synthesized
LPSSGYLQDHHYYGMDV

SEQ ID NO: 564 - protein, 13 aa, Artificial Sequence
  chemically synthesized
AAVGDGYSYGRLD

SEQ ID NO: 565 - protein, 18 aa, Artificial Sequence
  chemically synthesized
LPSYYYDSSGYFTWYFDL

SEQ ID NO: 566 - protein, 13 aa, Artificial Sequence
  chemically synthesized
ELYNYGSKDYFDY

SEQ ID NO: 567 - protein, 14 aa, Artificial Sequence
  chemically synthesized
GGTWDTAMVTGFDY

SEQ ID NO: 568 - protein, 15 aa, Artificial Sequence
  chemically synthesized
PHYDILTGSRAPFDY

SEQ ID NO: 569 - protein, 12 aa, Artificial Sequence
  chemically synthesized
ARVESKDGYFDY

SEQ ID NO: 570 - protein, 12 aa, Artificial Sequence
  chemically synthesized
DLRLSTWDAYDF

SEQ ID NO: 571 - protein, 8 aa, Artificial Sequence
  chemically synthesized
NSQRSFDY

SEQ ID NO: 572 - protein, 12 aa, Artificial Sequence
  chemically synthesized
DLGDPRGGILNY

SEQ ID NO: 573 - protein, 16 aa, Artificial Sequence
  chemically synthesized
SSPWGELSLYQGAFDI

SEQ ID NO: 574 - protein, 12 aa, Artificial Sequence
  chemically synthesized
DNDFWSGKVFDY

SEQ ID NO: 575 - protein, 12 aa, Artificial Sequence
  chemically synthesized
EGGSGWRHYFDY

SEQ ID NO: 576 - protein, 14 aa, Artificial Sequence
  chemically synthesized
DYCSSTSCQNWFDP

SEQ ID NO: 577 - protein, 10 aa, Artificial Sequence
  chemically synthesized
GRVAGDAFDI

SEQ ID NO: 578 - protein, 14 aa, Artificial Sequence
  chemically synthesized
DQGAAAGTLGYFDY

SEQ ID NO: 579 - protein, 14 aa, Artificial Sequence
  chemically synthesized
GIYDSSGSSNPFDS

SEQ ID NO: 580 - protein, 15 aa, Artificial Sequence
  chemically synthesized
GYCSGGSCPGTDFDY

SEQ ID NO: 581 - protein, 13 aa, Artificial Sequence
  chemically synthesized
DGVGGRDGYNFDY

SEQ ID NO: 582 - protein, 11 aa, Artificial Sequence
  chemically synthesized
APLAADGYFDY

SEQ ID NO: 583 - protein, 13 aa, Artificial Sequence
  chemically synthesized
ARGLQYLIWYFDL

SEQ ID NO: 584 - protein, 14 aa, Artificial Sequence
  chemically synthesized
PGMVRGVITAPLDY

SEQ ID NO: 585 - protein, 11 aa, Artificial Sequence
  chemically synthesized
EAKWGMYYFDY

SEQ ID NO: 586 - protein, 9 aa, Artificial Sequence
  chemically synthesized
GGGASYTDS

SEQ ID NO: 587 - protein, 15 aa, Artificial Sequence
  chemically synthesized
KGGYVGYSYGPFGGY

SEQ ID NO: 588 - protein, 12 aa, Artificial Sequence
  chemically synthesized
GGTMVRGFGFNY

SEQ ID NO: 589 - protein, 18 aa, Artificial Sequence
  chemically synthesized
ARRAMIGPLPRLVGYFDL

SEQ ID NO: 590 - protein, 16 aa, Artificial Sequence
  chemically synthesized
GRPAPSWVKTRNWFDP

SEQ ID NO: 591 - protein, 7 aa, Artificial Sequence
  chemically synthesized
EASSGWN

SEQ ID NO: 592 - protein, 12 aa, Artificial Sequence
  chemically synthesized
GGRYTKGGYFDD

SEQ ID NO: 593 - protein, 13 aa, Artificial Sequence
  chemically synthesized
RLDSSGRGGYFDY

SEQ ID NO: 594 - protein, 18 aa, Artificial Sequence
  chemically synthesized
ELVGTSSPYYYYYYGMDV

SEQ ID NO: 595 - protein, 10 aa, Artificial Sequence
  chemically synthesized
DYYYGSGSSP

SEQ ID NO: 596 - protein, 17 aa, Artificial Sequence
  chemically synthesized
GRPYCSSTSCYPEWFDP

SEQ ID NO: 597 - protein, 18 aa, Artificial Sequence
  chemically synthesized
LRGIDYYDSSGYQRGFDY

SEQ ID NO: 598 - protein, 11 aa, Artificial Sequence
  chemically synthesized
GGRGDGAAFDI

SEQ ID NO: 599 - protein, 14 aa, Artificial Sequence
  chemically synthesized
PPDGGNSGRWYFDL

SEQ ID NO: 600 - protein, 20 aa, Artificial Sequence
  chemically synthesized
DKNVRKHDYGDHPYGGYFDY

SEQ ID NO: 601 - protein, 9 aa, Artificial Sequence
  chemically synthesized
VAGATSLWY

SEQ ID NO: 602 - protein, 9 aa, Artificial Sequence
  chemically synthesized
LANSDGVDV

SEQ ID NO: 603 - protein, 8 aa, Artificial Sequence
  chemically synthesized
GVTRTFDY

SEQ ID NO: 604 - protein, 7 aa, Artificial Sequence
  chemically synthesized
GNGPFDP

SEQ ID NO: 605 - protein, 11 aa, Artificial Sequence
  chemically synthesized
RDTPLVGVSIY

SEQ ID NO: 606 - protein, 12 aa, Artificial Sequence
  chemically synthesized
RAGYGDYRHFQH

SEQ ID NO: 607 - protein, 10 aa, Artificial Sequence
  chemically synthesized
TGDRFQEFDY

SEQ ID NO: 608 - protein, 11 aa, Artificial Sequence
  chemically synthesized
DDRGRGDDFDY

SEQ ID NO: 609 - protein, 12 aa, Artificial Sequence
  chemically synthesized
HGRAGINWYFDL

SEQ ID NO: 610 - protein, 9 aa, Artificial Sequence
  chemically synthesized
GGGLWAFDI

SEQ ID NO: 611 - protein, 8 aa, Artificial Sequence
  chemically synthesized
DKIGSCPY

SEQ ID NO: 612 - protein, 11 aa, Artificial Sequence
  chemically synthesized
RPDSSSQCFDY

SEQ ID NO: 613 - protein, 10 aa, Artificial Sequence
  chemically synthesized
SSGWSLPEDY

SEQ ID NO: 614 - protein, 13 aa, Artificial Sequence
  chemically synthesized
DVNPELLGAGFDY

SEQ ID NO: 615 - protein, 12 aa, Artificial Sequence
  chemically synthesized
SLNSGGYRCFHH

SEQ ID NO: 616 - protein, 14 aa, Artificial Sequence
  chemically synthesized
APRGVVPAAMRGGY

SEQ ID NO: 617 - protein, 13 aa, Artificial Sequence
  chemically synthesized
LVGNSGSYYPFGY

SEQ ID NO: 618 - protein, 21 aa, Artificial Sequence
  chemically synthesized
GRSLPYRGLAPRSFGGYYFDY

SEQ ID NO: 619 - protein, 12 aa, Artificial Sequence
  chemically synthesized
GRTHWGPQDFDY

SEQ ID NO: 620 - protein, 15 aa, Artificial Sequence
  chemically synthesized
GGMYYYGSGSSYFDY

SEQ ID NO: 621 - protein, 12 aa, Artificial Sequence
  chemically synthesized
KIAAAGKQPVDY

SEQ ID NO: 622 - protein, 23 aa, Artificial Sequence
  chemically synthesized
RKVYDYVWGSYRLPGSVSYYFDY

SEQ ID NO: 623 - protein, 10 aa, Artificial Sequence
  chemically synthesized
LPGRAARPDY

SEQ ID NO: 624 - protein, 16 aa, Artificial Sequence
  chemically synthesized
GPGAVAGTKPKYYFDY

SEQ ID NO: 625 - protein, 14 aa, Artificial Sequence
  chemically synthesized
ATYYYDSSGYRFDY

SEQ ID NO: 626 - protein, 5 aa, Artificial Sequence
  chemically synthesized
RNLGY

SEQ ID NO: 627 - protein, 18 aa, Artificial Sequence
  chemically synthesized
ARYYDSSGYIAPSGYFDY

SEQ ID NO: 628 - protein, 13 aa, Artificial Sequence
  chemically synthesized
DGPAVDGAEYFQH

SEQ ID NO: 629 - protein, 11 aa, Artificial Sequence
  chemically synthesized
LASGSPPPGDY

SEQ ID NO: 630 - protein, 10 aa, Artificial Sequence
  chemically synthesized
GPIVGATMDY

SEQ ID NO: 631 - protein, 9 aa, Artificial Sequence
  chemically synthesized
WYGDYGLDY

SEQ ID NO: 632 - protein, 19 aa, Artificial Sequence
  chemically synthesized
VAKYYYESGGYRASNWFDP

SEQ ID NO: 633 - protein, 15 aa, Artificial Sequence
  chemically synthesized
APPPTVGWYAPVFDY

SEQ ID NO: 634 - protein, 11 aa, Artificial Sequence
  chemically synthesized
VTGRRVGAHDY

SEQ ID NO: 635 - protein, 12 aa, Artificial Sequence
  chemically synthesized
AQPGAETLNFDL

SEQ ID NO: 636 - protein, 8 aa, Artificial Sequence
  chemically synthesized
QVAGGMDV

SEQ ID NO: 637 - protein, 14 aa, Artificial Sequence
  chemically synthesized
GSVYSGSYYMLIDY

SEQ ID NO: 638 - protein, 13 aa, Artificial Sequence
  chemically synthesized
QDKDNTRYSGLGV

SEQ ID NO: 639 - protein, 14 aa, Artificial Sequence
  chemically synthesized
GPRMWSSGIDAFDI

SEQ ID NO: 640 - protein, 8 aa, Artificial Sequence
  chemically synthesized
RDWAGKRV

SEQ ID NO: 641 - protein, 10 aa, Artificial Sequence
  chemically synthesized
GRAGIAAFDI

SEQ ID NO: 642 - protein, 12 aa, Artificial Sequence
  chemically synthesized
GALQGEWRRFDY

SEQ ID NO: 643 - protein, 14 aa, Artificial Sequence
  chemically synthesized
TNQGYGGNSGVFDY

SEQ ID NO: 644 - protein, 8 aa, Artificial Sequence
  chemically synthesized
IVGGAVDC

SEQ ID NO: 645 - protein, 15 aa, Artificial Sequence
  chemically synthesized
VRVGATTVYDSWFDP

SEQ ID NO: 646 - protein, 20 aa, Artificial Sequence
  chemically synthesized
DGGSSPYYDSSGLLPWYFDL

SEQ ID NO: 647 - protein, 10 aa, Artificial Sequence
  chemically synthesized
AKFWTYYFDY

SEQ ID NO: 648 - protein, 14 aa, Artificial Sequence
  chemically synthesized
GGGSGSYYKRFFDY

SEQ ID NO: 649 - protein, 18 aa, Artificial Sequence
  chemically synthesized
DGTVRRVVGATTPGNFDY

SEQ ID NO: 650 - protein, 15 aa, Artificial Sequence
  chemically synthesized
DLNRGYCSGGSCFGY

SEQ ID NO: 651 - protein, 11 aa, Artificial Sequence
  chemically synthesized
DYSSSGECFDY

SEQ ID NO: 652 - protein, 11 aa, Artificial Sequence
  chemically synthesized
DQAAMVGYFDY

SEQ ID NO: 653 - protein, 14 aa, Artificial Sequence
  chemically synthesized
TFAGYSSKLGYFDL

SEQ ID NO: 654 - protein, 11 aa, Artificial Sequence
  chemically synthesized
ASQSIGSNLVW

SEQ ID NO: 655 - protein, 12 aa, Artificial Sequence
  chemically synthesized
ASQSVSSSYLAW

SEQ ID NO: 656 - protein, 11 aa, Artificial Sequence
  chemically synthesized
ASQSVSSYLAW

SEQ ID NO: 657 - protein, 17 aa, Artificial Sequence
  chemically synthesized
SSRNILYSGNNKNFLAW

SEQ ID NO: 658 - protein, 12 aa, Artificial Sequence
  chemically synthesized
ASESVSKSYLLW

SEQ ID NO: 659 - protein, 12 aa, Artificial Sequence
  chemically synthesized
ASQSISSTYLAW

SEQ ID NO: 660 - protein, 17 aa, Artificial Sequence
  chemically synthesized
SSQALRNVVGLGDDLAW

SEQ ID NO: 661 - protein, 16 aa, Artificial Sequence
  chemically synthesized
SSQSLLNSNGYNYLEW

SEQ ID NO: 662 - protein, 11 aa, Artificial Sequence
  chemically synthesized
ASQSVSSNLAW

SEQ ID NO: 663 - protein, 11 aa, Artificial Sequence
  chemically synthesized
ASQSVRDNVGW

SEQ ID NO: 664 - protein, 11 aa, Artificial Sequence
  chemically synthesized
ASQSISSYLNW

SEQ ID NO: 665 - protein, 11 aa, Artificial Sequence
  chemically synthesized
ASQSVNSNVAW

SEQ ID NO: 666 - protein, 12 aa, Artificial Sequence
  chemically synthesized
ASQSVSSSALAW

SEQ ID NO: 667 - protein, 16 aa, Artificial Sequence
  chemically synthesized
SSQSLLHSNGYNYLDW

SEQ ID NO: 668 - protein, 11 aa, Artificial Sequence
  chemically synthesized
ASQGISSSLAW

SEQ ID NO: 669 - protein, 16 aa, Artificial Sequence
  chemically synthesized
SCQSLVYSDGNTYLNC

SEQ ID NO: 670 - protein, 11 aa, Artificial Sequence
  chemically synthesized
ASEGLTTNLAW

SEQ ID NO: 671 - protein, 16 aa, Artificial Sequence
  chemically synthesized
SSQSLEHTDGNTYLSW

SEQ ID NO: 672 - protein, 12 aa, Artificial Sequence
  chemically synthesized
ASQSISGSYLAW

SEQ ID NO: 673 - protein, 16 aa, Artificial Sequence
  chemically synthesized
SSQSLLHSNGNNYLDW

SEQ ID NO: 674 - protein, 11 aa, Artificial Sequence
  chemically synthesized
ASQNIRHWLVW

SEQ ID NO: 675 - protein, 11 aa, Artificial Sequence
  chemically synthesized
ASQSIGGSLHW

SEQ ID NO: 676 - protein, 12 aa, Artificial Sequence
  chemically synthesized
ASQSVTSNYLAW

SEQ ID NO: 677 - protein, 11 aa, Artificial Sequence
  chemically synthesized
ASQSISSNLAW

SEQ ID NO: 678 - protein, 17 aa, Artificial Sequence
  chemically synthesized
SSQSVLYSSNNKNYLAW

SEQ ID NO: 679 - protein, 11 aa, Artificial Sequence
  chemically synthesized
ASQSLSTNLAW

SEQ ID NO: 680 - protein, 11 aa, Artificial Sequence
  chemically synthesized
ASQSISSWLAW

SEQ ID NO: 681 - protein, 12 aa, Artificial Sequence
  chemically synthesized
ASHSVGANYIAW

SEQ ID NO: 682 - protein, 11 aa, Artificial Sequence
  chemically synthesized
ASQGIANYLAW

SEQ ID NO: 683 - protein, 17 aa, Artificial Sequence
  chemically synthesized
SSQSVLYRTNNKNYLAW

SEQ ID NO: 684 - protein, 17 aa, Artificial Sequence
  chemically synthesized
SNRSVLYSPNNQNYLGW

SEQ ID NO: 685 - protein, 12 aa, Artificial Sequence
  chemically synthesized
ASESVNSNFLAW

SEQ ID NO: 686 - protein, 11 aa, Artificial Sequence
  chemically synthesized
ASQSIGSNLAW

SEQ ID NO: 687 - protein, 11 aa, Artificial Sequence
  chemically synthesized
ASQSVGNSLAW

SEQ ID NO: 688 - protein, 11 aa, Artificial Sequence
  chemically synthesized
ASQSITNWLAW

SEQ ID NO: 689 - protein, 11 aa, Artificial Sequence
  chemically synthesized
ARQSISNRLAW

SEQ ID NO: 690 - protein, 12 aa, Artificial Sequence
  chemically synthesized
ASQNVYSNFLAW

SEQ ID NO: 691 - protein, 16 aa, Artificial Sequence
  chemically synthesized
SSQSLEHGDGNTYLSW

SEQ ID NO: 692 - protein, 12 aa, Artificial Sequence
  chemically synthesized
ASQSVSSTSLAW

SEQ ID NO: 693 - protein, 11 aa, Artificial Sequence
  chemically synthesized
ASQSVGSKLAW

SEQ ID NO: 694 - protein, 16 aa, Artificial Sequence
  chemically synthesized
SSQSLLGGDGKTYLYW

SEQ ID NO: 695 - protein, 12 aa, Artificial Sequence
  chemically synthesized
ASQSVSSNSLAW

SEQ ID NO: 696 - protein, 16 aa, Artificial Sequence
  chemically synthesized
SSQSLVYSDGNTYLNW

SEQ ID NO: 697 - protein, 11 aa, Artificial Sequence
  chemically synthesized
ASQSISRWLAW

SEQ ID NO: 698 - protein, 11 aa, Artificial Sequence
  chemically synthesized
PSQDIGTYLNW

SEQ ID NO: 699 - protein, 11 aa, Artificial Sequence
  chemically synthesized
ASQSISSCLAW

SEQ ID NO: 700 - protein, 16 aa, Artificial Sequence
  chemically synthesized
SSQSLLHSDGKTYLYW

SEQ ID NO: 701 - protein, 17 aa, Artificial Sequence
  chemically synthesized
SSQSVLYSSNNKNYIAW

SEQ ID NO: 702 - protein, 12 aa, Artificial Sequence
  chemically synthesized
ASQSLTSSYLAW

SEQ ID NO: 703 - protein, 16 aa, Artificial Sequence
  chemically synthesized
SSQSLVHSNGHTYLSW

SEQ ID NO: 704 - protein, 11 aa, Artificial Sequence
  chemically synthesized
ASQSVGSDLAW

SEQ ID NO: 705 - protein, 16 aa, Artificial Sequence
  chemically synthesized
SSQSLLHSSGYNYLDW

SEQ ID NO: 706 - protein, 11 aa, Artificial Sequence
  chemically synthesized
ASQTINSWLAW

SEQ ID NO: 707 - protein, 12 aa, Artificial Sequence
  chemically synthesized
ASQTIGPKSFGW

SEQ ID NO: 708 - protein, 16 aa, Artificial Sequence
  chemically synthesized
SSQSLVYSDGNTYLYW

SEQ ID NO: 709 - protein, 11 aa, Artificial Sequence
  chemically synthesized
ASQSITTWLAW

SEQ ID NO: 710 - protein, 11 aa, Artificial Sequence
  chemically synthesized
ASQSIGTYVAW

SEQ ID NO: 711 - protein, 12 aa, Artificial Sequence
  chemically synthesized
ASQSVNSGYLAW

SEQ ID NO: 712 - protein, 12 aa, Artificial Sequence
  chemically synthesized
ASQSVSSSYLGW

SEQ ID NO: 713 - protein, 11 aa, Artificial Sequence
  chemically synthesized
ASQSISNNLAW

SEQ ID NO: 714 - protein, 12 aa, Artificial Sequence
  chemically synthesized
ASQSVSSSSLAW

SEQ ID NO: 715 - protein, 16 aa, Artificial Sequence
  chemically synthesized
SNQSLVYSDGGTYLNW

SEQ ID NO: 716 - protein, 11 aa, Artificial Sequence
  chemically synthesized
ASQSISNYLNW

SEQ ID NO: 717 - protein, 11 aa, Artificial Sequence
  chemically synthesized
ASQSVSTLLAW

SEQ ID NO: 718 - protein, 11 aa, Artificial Sequence
  chemically synthesized
ASQGIRNDLGW

SEQ ID NO: 719 - protein, 16 aa, Artificial Sequence
  chemically synthesized
SSHSLTTTDGRTYVAW

SEQ ID NO: 720 - protein, 11 aa, Artificial Sequence
  chemically synthesized
ASQSVTSNLAW

SEQ ID NO: 721 - protein, 12 aa, Artificial Sequence
  chemically synthesized
ASQSVFNNYLAW

SEQ ID NO: 722 - protein, 17 aa, Artificial Sequence
  chemically synthesized
SSQSVLYDSNSKNYLSW

SEQ ID NO: 723 - protein, 11 aa, Artificial Sequence
  chemically synthesized
ASQSVGTNLAW

SEQ ID NO: 724 - protein, 16 aa, Artificial Sequence
  chemically synthesized
SSQSLVYSDGNTYLSW

SEQ ID NO: 725 - protein, 12 aa, Artificial Sequence
  chemically synthesized
ASQSVISRYLAW

SEQ ID NO: 726 - protein, 11 aa, Artificial Sequence
  chemically synthesized
ASQSVSSSLAW

SEQ ID NO: 727 - protein, 8 aa, Artificial Sequence
  chemically synthesized
SATSRATG

SEQ ID NO: 728 - protein, 8 aa, Artificial Sequence
  chemically synthesized
GASNRATG

SEQ ID NO: 729 - protein, 8 aa, Artificial Sequence
  chemically synthesized
DASNRATG

SEQ ID NO: 730 - protein, 8 aa, Artificial Sequence
  chemically synthesized
WASTRESG

SEQ ID NO: 731 - protein, 8 aa, Artificial Sequence
  chemically synthesized
GASTRASG

SEQ ID NO: 732 - protein, 8 aa, Artificial Sequence
  chemically synthesized
GASTRATG

SEQ ID NO: 733 - protein, 8 aa, Artificial Sequence
  chemically synthesized
STSTLQSG

SEQ ID NO: 734 - protein, 8 aa, Artificial Sequence
  chemically synthesized
LGSNRASG

SEQ ID NO: 735 - protein, 8 aa, Artificial Sequence
  chemically synthesized
GASSRATG

SEQ ID NO: 736 - protein, 8 aa, Artificial Sequence
  chemically synthesized
AASSLHTG

SEQ ID NO: 737 - protein, 8 aa, Artificial Sequence
  chemically synthesized
DVSTRATD

SEQ ID NO: 738 - protein, 8 aa, Artificial Sequence
  chemically synthesized
DASSRATG

SEQ ID NO: 739 - protein, 8 aa, Artificial Sequence
  chemically synthesized
DSSSRATG

SEQ ID NO: 740 - protein, 8 aa, Artificial Sequence
  chemically synthesized
MGSSRASG

SEQ ID NO: 741 - protein, 8 aa, Artificial Sequence
  chemically synthesized
AASTLQSG

SEQ ID NO: 742 - protein, 8 aa, Artificial Sequence
  chemically synthesized
KVSNRDSG

SEQ ID NO: 743 - protein, 8 aa, Artificial Sequence
  chemically synthesized
LGSTRASG

SEQ ID NO: 744 - protein, 8 aa, Artificial Sequence
  chemically synthesized
AASTRATG

SEQ ID NO: 745 - protein, 8 aa, Artificial Sequence
  chemically synthesized
KVSTRFSG

SEQ ID NO: 746 - protein, 8 aa, Artificial Sequence
  chemically synthesized
DASSRAEG

SEQ ID NO: 747 - protein, 8 aa, Artificial Sequence
  chemically synthesized
AASNLQSG

SEQ ID NO: 748 - protein, 8 aa, Artificial Sequence
  chemically synthesized
YASQSFSG

SEQ ID NO: 749 - protein, 8 aa, Artificial Sequence
  chemically synthesized
GASYRATG

SEQ ID NO: 750 - protein, 8 aa, Artificial Sequence
  chemically synthesized
WASARESG

SEQ ID NO: 751 - protein, 8 aa, Artificial Sequence
  chemically synthesized
TASKRATG

SEQ ID NO: 752 - protein, 8 aa, Artificial Sequence
  chemically synthesized
ASSTLQSG

SEQ ID NO: 753 - protein, 8 aa, Artificial Sequence
  chemically synthesized
WASTRDSG

SEQ ID NO: 754 - protein, 8 aa, Artificial Sequence
  chemically synthesized
DASTRATG

SEQ ID NO: 755 - protein, 8 aa, Artificial Sequence
  chemically synthesized
GASSLQSG

SEQ ID NO: 756 - protein, 8 aa, Artificial Sequence
  chemically synthesized
KASTLANG

SEQ ID NO: 757 - protein, 8 aa, Artificial Sequence
  chemically synthesized
GASSRAAG

SEQ ID NO: 758 - protein, 8 aa, Artificial Sequence
  chemically synthesized
KVSNRLSG

SEQ ID NO: 759 - protein, 8 aa, Artificial Sequence
  chemically synthesized
GASRRATG

SEQ ID NO: 760 - protein, 8 aa, Artificial Sequence
  chemically synthesized
EVSNRFSG

SEQ ID NO: 761 - protein, 8 aa, Artificial Sequence
  chemically synthesized
AASYRATG

SEQ ID NO: 762 - protein, 8 aa, Artificial Sequence
  chemically synthesized
GASSRASG

SEQ ID NO: 763 - protein, 8 aa, Artificial Sequence
  chemically synthesized
KASTIKSG

SEQ ID NO: 764 - protein, 8 aa, Artificial Sequence
  chemically synthesized
AASNLHSG

SEQ ID NO: 765 - protein, 8 aa, Artificial Sequence
  chemically synthesized
LGSNRAPG

SEQ ID NO: 766 - protein, 8 aa, Artificial Sequence
  chemically synthesized
RASSRATG

SEQ ID NO: 767 - protein, 8 aa, Artificial Sequence
  chemically synthesized
EVSNRDSG

SEQ ID NO: 768 - protein, 8 aa, Artificial Sequence
  chemically synthesized
RASTRAAG

SEQ ID NO: 769 - protein, 8 aa, Artificial Sequence
  chemically synthesized
RASRLESG

SEQ ID NO: 770 - protein, 7 aa, Artificial Sequence
  chemically synthesized
DSNRATG

SEQ ID NO: 771 - protein, 8 aa, Artificial Sequence
  chemically synthesized
KVSKRDSG

SEQ ID NO: 772 - protein, 8 aa, Artificial Sequence
  chemically synthesized
KASSLTSG

SEQ ID NO: 773 - protein, 8 aa, Artificial Sequence
  chemically synthesized
DSSNRATG

SEQ ID NO: 774 - protein, 8 aa, Artificial Sequence
  chemically synthesized
GVSTRATG

SEQ ID NO: 775 - protein, 8 aa, Artificial Sequence
  chemically synthesized
GASSRATD

SEQ ID NO: 776 - protein, 8 aa, Artificial Sequence
  chemically synthesized
GTSTRATG

SEQ ID NO: 777 - protein, 8 aa, Artificial Sequence
  chemically synthesized
DASNLETG

SEQ ID NO: 778 - protein, 8 aa, Artificial Sequence
  chemically synthesized
AASSLQSG

SEQ ID NO: 779 - protein, 8 aa, Artificial Sequence
  chemically synthesized
EVSKRDSG

SEQ ID NO: 780 - protein, 8 aa, Artificial Sequence
  chemically synthesized
WASTRGSG

SEQ ID NO: 781 - protein, 8 aa, Artificial Sequence
  chemically synthesized
KISNRFSG

SEQ ID NO: 782 - protein, 8 aa, Artificial Sequence
  chemically synthesized
KASSLESG

SEQ ID NO: 783 - protein, 8 aa, Artificial Sequence
  chemically synthesized
GASTRATA

SEQ ID NO: 784 - protein, 9 aa, Artificial Sequence
  chemically synthesized
YGSSPPTTF

SEQ ID NO: 785 - protein, 8 aa, Artificial Sequence
  chemically synthesized
YGSSPGTF

SEQ ID NO: 786 - protein, 8 aa, Artificial Sequence
  chemically synthesized
RSNWPRTF

SEQ ID NO: 787 - protein, 8 aa, Artificial Sequence
  chemically synthesized
SSSLPHTF

SEQ ID NO: 788 - protein, 7 aa, Artificial Sequence
  chemically synthesized
YGSSRTF

SEQ ID NO: 789 - protein, 10 aa, Artificial Sequence
  chemically synthesized
YGNSPPGATF

SEQ ID NO: 790 - protein, 8 aa, Artificial Sequence
  chemically synthesized
HHDFPFTF

SEQ ID NO: 791 - protein, 8 aa, Artificial Sequence
  chemically synthesized
SLQTPLTF

SEQ ID NO: 792 - protein, 9 aa, Artificial Sequence
  chemically synthesized
YGSSPRITF

SEQ ID NO: 793 - protein, 10 aa, Artificial Sequence
  chemically synthesized
YNNWPPMYTF

SEQ ID NO: 794 - protein, 8 aa, Artificial Sequence
  chemically synthesized
FNNWPYTF

SEQ ID NO: 795 - protein, 8 aa, Artificial Sequence
  chemically synthesized
SYSIPRTF

SEQ ID NO: 796 - protein, 9 aa, Artificial Sequence
  chemically synthesized
CASSPPVTF

SEQ ID NO: 797 - protein, 9 aa, Artificial Sequence
  chemically synthesized
YGSSPRVTF

SEQ ID NO: 798 - protein, 8 aa, Artificial Sequence
  chemically synthesized
FNTYPNTF

SEQ ID NO: 799 - protein, 7 aa, Artificial Sequence
  chemically synthesized
TLHTVTF

SEQ ID NO: 800 - protein, 7 aa, Artificial Sequence
  chemically synthesized
YGSSLLF

SEQ ID NO: 801 - protein, 9 aa, Artificial Sequence
  chemically synthesized
YDNLPPLTF

SEQ ID NO: 802 - protein, 8 aa, Artificial Sequence
  chemically synthesized
ALQTPYTF

SEQ ID NO: 803 - protein, 8 aa, Artificial Sequence
  chemically synthesized
GLQTPFTF

SEQ ID NO: 804 - protein, 9 aa, Artificial Sequence
  chemically synthesized
YGSSPALTF

SEQ ID NO: 805 - protein, 8 aa, Artificial Sequence
  chemically synthesized
ALHTPWTF

SEQ ID NO: 806 - protein, 9 aa, Artificial Sequence
  chemically synthesized
YNHWPLYTF

SEQ ID NO: 807 - protein, 8 aa, Artificial Sequence
  chemically synthesized
GSNWPLTF

SEQ ID NO: 808 - protein, 8 aa, Artificial Sequence
  chemically synthesized
ATHYPRTF

SEQ ID NO: 809 - protein, 9 aa, Artificial Sequence
  chemically synthesized
YGSSPIFTF

SEQ ID NO: 810 - protein, 8 aa, Artificial Sequence
  chemically synthesized
GLQIPITF

SEQ ID NO: 811 - protein, 8 aa, Artificial Sequence
  chemically synthesized
HNSYPWTF

SEQ ID NO: 812 - protein, 8 aa, Artificial Sequence
  chemically synthesized
SISLPLTF

SEQ ID NO: 813 - protein, 7 aa, Artificial Sequence
  chemically synthesized
YASSVTF

SEQ ID NO: 814 - protein, 8 aa, Artificial Sequence
  chemically synthesized
YNNWPRTF

SEQ ID NO: 815 - protein, 8 aa, Artificial Sequence
  chemically synthesized
FYSPPRTF

SEQ ID NO: 816 - protein, 9 aa, Artificial Sequence
  chemically synthesized
YGSSPPGTF

SEQ ID NO: 817 - protein, 9 aa, Artificial Sequence
  chemically synthesized
YHNWPPYTF

SEQ ID NO: 818 - protein, 7 aa, Artificial Sequence
  chemically synthesized
YNSYWTF

SEQ ID NO: 819 - protein, 8 aa, Artificial Sequence
  chemically synthesized
YAAAPITF

SEQ ID NO: 820 - protein, 8 aa, Artificial Sequence
  chemically synthesized
YNSVPLTF

SEQ ID NO: 821 - protein, 8 aa, Artificial Sequence
  chemically synthesized
YYNLPRSF

SEQ ID NO: 822 - protein, 8 aa, Artificial Sequence
  chemically synthesized
YASTPYTF

SEQ ID NO: 823 - protein, 8 aa, Artificial Sequence
  chemically synthesized
YNNWPLTF

SEQ ID NO: 824 - protein, 8 aa, Artificial Sequence
  chemically synthesized
RSNWSLTF

SEQ ID NO: 825 - protein, 9 aa, Artificial Sequence
  chemically synthesized
YGPSRRITF

SEQ ID NO: 826 - protein, 7 aa, Artificial Sequence
  chemically synthesized
HGEWPTF

SEQ ID NO: 827 - protein, 9 aa, Artificial Sequence
  chemically synthesized
RGTWPPLTF

SEQ ID NO: 828 - protein, 8 aa, Artificial Sequence
  chemically synthesized
YTNYPRTF

SEQ ID NO: 829 - protein, 7 aa, Artificial Sequence
  chemically synthesized
YQSYWTF

SEQ ID NO: 830 - protein, 8 aa, Artificial Sequence
  chemically synthesized
YNSPPRTF

SEQ ID NO: 831 - protein, 8 aa, Artificial Sequence
  chemically synthesized
YGTSPITF

SEQ ID NO: 832 - protein, 8 aa, Artificial Sequence
  chemically synthesized
GIYWPRTF

SEQ ID NO: 833 - protein, 9 aa, Artificial Sequence
  chemically synthesized
YGSSPPITF

SEQ ID NO: 834 - protein, 9 aa, Artificial Sequence
  chemically synthesized
YNNWPPITF

SEQ ID NO: 835 - protein, 8 aa, Artificial Sequence
  chemically synthesized
TLQTPLTF

SEQ ID NO: 836 - protein, 9 aa, Artificial Sequence
  chemically synthesized
YYSSTPYTF

SEQ ID NO: 837 - protein, 8 aa, Artificial Sequence
  chemically synthesized
STQFPWTF

SEQ ID NO: 838 - protein, 8 aa, Artificial Sequence
  chemically synthesized
YNNWPHTF

SEQ ID NO: 839 - protein, 7 aa, Artificial Sequence
  chemically synthesized
YGNSQTF

SEQ ID NO: 840 - protein, 8 aa, Artificial Sequence
  chemically synthesized
GTHWPRTF

SEQ ID NO: 841 - protein, 8 aa, Artificial Sequence
  chemically synthesized
YKSDSRTF

SEQ ID NO: 842 - protein, 7 aa, Artificial Sequence
  chemically synthesized
SYGPRTF

SEQ ID NO: 843 - protein, 8 aa, Artificial Sequence
  chemically synthesized
YGSSGYTF

SEQ ID NO: 844 - protein, 5 aa, Artificial Sequence
  chemically synthesized
YGSSF

SEQ ID NO: 845 - protein, 8 aa, Artificial Sequence
  chemically synthesized
LNSYPQTF

SEQ ID NO: 846 - protein, 8 aa, Artificial Sequence
  chemically synthesized
SIQLPLTF

SEQ ID NO: 847 - protein, 8 aa, Artificial Sequence
  chemically synthesized
YYYIPRTF

SEQ ID NO: 848 - protein, 7 aa, Artificial Sequence
  chemically synthesized
ALQTRTF

SEQ ID NO: 849 - protein, 8 aa, Artificial Sequence
  chemically synthesized
YGSSPNTF

SEQ ID NO: 850 - protein, 9 aa, Artificial Sequence
  chemically synthesized
GTHWPPLTV

SEQ ID NO: 851 - protein, 8 aa, Artificial Sequence
  chemically synthesized
YGRSPYTS

SEQ ID NO: 852 - protein, 8 aa, Artificial Sequence
  chemically synthesized
YYSTPLTF

SEQ ID NO: 853 - protein, 8 aa, Artificial Sequence
  chemically synthesized
GLQIPLTF

SEQ ID NO: 854 - protein, 8 aa, Artificial Sequence
  chemically synthesized
SIQLPWTF

SEQ ID NO: 855 - protein, 7 aa, Artificial Sequence
  chemically synthesized
YNNWPRF

SEQ ID NO: 856 - protein, 8 aa, Artificial Sequence
  chemically synthesized
YNSYSPTF

SEQ ID NO: 857 - protein, 8 aa, Artificial Sequence
  chemically synthesized
RYNWPITF

SEQ ID NO: 858 - protein, 8 aa, Artificial Sequence
  chemically synthesized
RSRWPLTF

SEQ ID NO: 859 - protein, 8 aa, Artificial Sequence
  chemically synthesized
GRHWPYTL

SEQ ID NO: 860 - protein, 8 aa, Artificial Sequence
  chemically synthesized
YNSYSRTF

SEQ ID NO: 861 - protein, 8 aa, Artificial Sequence
  chemically synthesized
YNGASRMF

SEQ ID NO: 862 - protein, 7 aa, Artificial Sequence
  chemically synthesized
RSNWPFF

SEQ ID NO: 863 - protein, 8 aa, Artificial Sequence
  chemically synthesized
RAEWPLTF

SEQ ID NO: 864 - protein, 9 aa, Artificial Sequence
  chemically synthesized
YGNSAMYNF

SEQ ID NO: 865 - protein, 9 aa, Artificial Sequence
  chemically synthesized
YNNWPPFTF

SEQ ID NO: 866 - protein, 8 aa, Artificial Sequence
  chemically synthesized
YGISPLAF

SEQ ID NO: 867 - protein, 9 aa, Artificial Sequence
  chemically synthesized
YNFWPSITF

SEQ ID NO: 868 - protein, 7 aa, Artificial Sequence
  chemically synthesized
YGSSQTF

SEQ ID NO: 869 - protein, 8 aa, Artificial Sequence
  chemically synthesized
GTHWPYTF

SEQ ID NO: 870 - protein, 8 aa, Artificial Sequence
  chemically synthesized
FDNVPVTF

SEQ ID NO: 871 - protein, 9 aa, Artificial Sequence
  chemically synthesized
YGSSSMYTF

SEQ ID NO: 872 - protein, 8 aa, Artificial Sequence
  chemically synthesized
SYITPWTF

SEQ ID NO: 873 - protein, 8 aa, Artificial Sequence
  chemically synthesized
RYVWPFTF

SEQ ID NO: 874 - protein, 8 aa, Artificial Sequence
  chemically synthesized
HNSYPRTF

SEQ ID NO: 875 - protein, 8 aa, Artificial Sequence
  chemically synthesized
RSNWPWTF

SEQ ID NO: 876 - protein, 8 aa, Artificial Sequence
  chemically synthesized
GTHGPHTF

SEQ ID NO: 877 - protein, 9 aa, Artificial Sequence
  chemically synthesized
YGSPPPTTF

SEQ ID NO: 878 - protein, 8 aa, Artificial Sequence
  chemically synthesized
YGSSRRTF

SEQ ID NO: 879 - protein, 8 aa, Artificial Sequence
  chemically synthesized
YGSSPITF

SEQ ID NO: 880 - protein, 9 aa, Artificial Sequence
  chemically synthesized
YGSSLRYTF

SEQ ID NO: 881 - protein, 7 aa, Artificial Sequence
  chemically synthesized
FYGIPHF

SEQ ID NO: 882 - protein, 8 aa, Artificial Sequence
  chemically synthesized
GTQFPQTF

SEQ ID NO: 883 - protein, 9 aa, Artificial Sequence
  chemically synthesized
YGSSPPYTF

SEQ ID NO: 884 - protein, 8 aa, Artificial Sequence
  chemically synthesized
YNSYSGTF

SEQ ID NO: 885 - protein, 8 aa, Artificial Sequence
  chemically synthesized
YDNWPPLF

SEQ ID NO: 886 - protein, 191 aa, Homo sapiens
  Human CLEC2D construct PEPTIDE (1)..(191)
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 887 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHVHHHHHHHH

SEQ ID NO: 888 - protein, 129 aa, Homo sapiens
  Human CLEC2D construct PEPTIDE (1)..(129)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHHG

SEQ ID NO: 889 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHVHHHHHHHH

SEQ ID NO: 890 - protein, 148 aa, Homo sapiens
  Human CLEC2D construct PEPTIDE (1)..(148)
MMSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHHG

SEQ ID NO: 891 - protein, 152 aa, Homo sapiens
  Human CLEC2D construct PEPTIDE (1)..(152)
MMSFVSLLLVGILFHATQAHHHHHHHHDDDDKQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIHV

SEQ ID NO: 892 - protein, 133 aa, Homo sapiens
  Human CLEC2D construct PEPTIDE (1)..(133)
HHHHHHHHDDDDKQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIHV

SEQ ID NO: 893 - protein, 147 aa, Homo sapiens
  Human CLEC2D construct PEPTIDE (1)..(147)
MMSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACAAAAAWICSKSDIHVHHHHHHHH

SEQ ID NO: 894 - protein, 253 aa, Homo sapiens
  Human CLEC2D construct PEPTIDE (1)..(253)
MQLLRCFSIFSVIASVLAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACAAAAAWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 895 - protein, 235 aa, Homo sapiens
  Human CLEC2D construct PEPTIDE (1)..(235)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACAAAAAWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 896 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACAAAAAWICSKSDIHVHHHHHHHH

SEQ ID NO: 897 - protein, 147 aa, Homo sapiens
  Human CLEC2D construct PEPTIDE (1)..(147)
MMSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAALADKGASSARCYTERKWICSKSDIHVHHHHHHHH

SEQ ID NO: 898 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAALADKGASSARCYTERKWICSKSDIHVHHHHHHHH

SEQ ID NO: 899 - protein, 253 aa, Homo sapiens
  Human CLEC2D construct PEPTIDE (1)..(253)
MQLLRCFSIFSVIASVLAQAACPESWIGFQRKCFYFSDDTKNWTSSQRFCDSQDADLAQVESFQELNFLLRYKGPSDHWIGLSREQGQPWKWINGTEWTRQFPILGAGECAALADKGASSARCYTERKWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 900 - protein, 235 aa, Homo sapiens
  Human CLEC2D construct PEPTIDE (1)..(235)
QAACPESWIGFQRKCFYFSDDTKNWTSSQRFCDSQDADLAQVESFQELNFLLRYKGPSDHWIGLSREQGQPWKWINGTEWTRQFPILGAGECAALADKGASSARCYTERKWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 901 - protein, 147 aa, Homo sapiens
  Human CLEC2D construct PEPTIDE (1)..(147)
MMSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDAGAASARCYTERKWICSKSDIHVHHHHHHHH

SEQ ID NO: 902 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDAGAASARCYTERKWICSKSDIHVHHHHHHHH

SEQ ID NO: 903 - protein, 253 aa, Homo sapiens
  Human CLEC2D construct PEPTIDE (1)..(253)
MQLLRCFSIFSVIASVLAQAACPESWIGFQRKCFYFSDDTKNWTSSQRFCDSQDADLAQVESFQELNFLLRYKGPSDHWIGLSREQGQPWKWINGTEWTRQFPILGAGECAYLNDAGAASARCYTERKWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 904 - protein, 235 aa, Homo sapiens
  Human CLEC2D construct PEPTIDE (1)..(235)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDAGAASARCYTERKWICSKSDIHVEFEQKLISEEDLDYKDDDDKENLYFQGLQASGGGGSGGGGSGGGGSQELTTICEQIPSPTLESTPYSLSTTTILANGKAMQGVFEYYKSVTFVSNCGSHPSTTSKGSPINTQYVF

SEQ ID NO: 905 - protein, 194 aa, Homo sapiens
  Human CLEC2D construct PEPTIDE (1)..(194)
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 906 - protein, 154 aa, Homo sapiens
  Human CLEC2D construct PEPTIDE (1)..(154)
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQ

SEQ ID NO: 907 - protein, 132 aa, Homo sapiens
  Human CLEC2D construct PEPTIDE (1)..(132)
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELVSYPGSRRVCLFE

SEQ ID NO: 908 - protein, 154 aa, Homo sapiens
  Human CLEC2D construct PEPTIDE (1)..(154)
MHDSNNVEKDITPSELPANPAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 909 - protein, 95 aa, Homo sapiens
  Human CLEC2D construct PEPTIDE (1)..(95)
MHDSNNVEKDITPSELPANPAIRANCHQEPSVCLQAACPESWIGFQRKCFYFSDDTKNWTSSQRFCDSQDADLAQVESFQELVSYPGSRRVCLFE

SEQ ID NO: 910 - protein, 233 aa, Rattus norvegicus
  Rat CLEC2D construct PEPTIDE (1)..(233)
MPSSAHLQDPPPLLSRTLTQNEGQTSLRQSSSCGPSAASASESLSGSTESRIPHSKMLQGKLPRNIPLEYPAGLYCCYVVIIVLSVAVVALSVALSVKKTAQISTINTYAACPRNWIGVGNKCFYFNEIPSNWTLSQTLCKEQGAELARFDTEEELNFLRRYKGSSGYWFGLHRESSAHPWKWTDNTEYNNSVSIGGDEKHGFLSDNGFSSGRGYIVRKSICRKPNSYTSQCL

SEQ ID NO: 911 - protein, 207 aa, Mus musculus
  mouse CLEC2D construct PEPTIDE (1)..(207)
MCVTKASLPMLSPTGSPQEVEVGKILQGKRHGTISPESCAKLYCYYGVIMVLTVAVIALSVALSATKTEQIPVNKTYAACPQNWIGVENKCFYFSEYPSNWTFAQAFCMAQEAQLARFDNQDELNFLMRYKANFDSWIGLHRESSEHPWKWTDNTEYNNTIPIRGEERFAYLNNNGISSTRIYSLRMWICSKLNSYSLHCQTPFFPS

SEQ ID NO: 912 - protein, 157 aa, Mus musculus
  mouse CLEC2D construct PEPTIDE (1)..(157)
MSFVSLLLVGILFHATQAYAACPQNWIGVENKCFYFSEYPSNWTFAQAFCMAQEAQLARFDNQDELNFLMRYKANFDSWIGLHRESSEHPWKWTDNTEYNNTIPIRGEERFAYLNNNGISSTRIYSLRMWICSKLNSYSLHCQTPFFPSHHHHHHHH

SEQ ID NO: 913 - protein, 139 aa, Mus musculus
  mouse CLEC2D construct PEPTIDE (1)..(139)
YAACPQNWIGVENKCFYFSEYPSNWTFAQAFCMAQEAQLARFDNQDELNFLMRYKANFDSWIGLHRESSEHPWKWTDNTEYNNTIPIRGEERFAYLNNNGISSTRIYSLRMWICSKLNSYSLHCQTPFFPSHHHHHHHH

SEQ ID NO: 914 - protein, 157 aa, Mus musculus
  mouse CLEC2D construct PEPTIDE (1)..(157)
MSFVSLLLVGILFHATQAYAACPQNWIGVENKCFYFSEYPSNWTFAQAFCMAQEAQLARFDNQDELNFLMRYKANFDSWIGLHRESSEHPWKWTDNTEYNNTIPIRGEERFAYLNNNGISSTRCYSLRMWICSKLNSYSLHCQTPFFPSHHHHHHHH

SEQ ID NO: 915 - protein, 139 aa, Mus musculus
  mouse CLEC2D construct PEPTIDE (1)..(139)
YAACPQNWIGVENKCFYFSEYPSNWTFAQAFCMAQEAQLARFDNQDELNFLMRYKANFDSWIGLHRESSEHPWKWTDNTEYNNTIPIRGEERFAYLNNNGISSTRCYSLRMWICSKLNSYSLHCQTPFFPSHHHHHHHH

SEQ ID NO: 916 - protein, 154 aa, Canis lupus
  Dog CLEC2D construct PEPTIDE (1)..(154)
MSFVSLLLVGILFHATQAEAACPESWIGFQRKCFYFSDDIKNWTFSQRFCDSYGADLVQIETLLELNFLLRYKGPYDHWIGLSRDLGQPWKWVNGTEWTNCFPIRGGGECAYLNDKGASSARRYTERKWICSKPDIYAQIKRQNSIHHHHHHHH

SEQ ID NO: 917 - protein, 136 aa, Canis lupus
  Dog CLEC2D construct PEPTIDE (1)..(136)
EAACPESWIGFQRKCFYFSDDIKNWTFSQRFCDSYGADLVQIETLLELNFLLRYKGPYDHWIGLSRDLGQPWKWVNGTEWTNCFPIRGGGECAYLNDKGASSARRYTERKWICSKPDIYAQIKRQNSIHHHHHHHH

SEQ ID NO: 918 - protein, 205 aa, Macaca fascicularis
  Cynomolgus CLEC2D construct PEPTIDE (1)..(205)
MVTGSKMHDSNNVEKDIAPSELPANPGYRHSKQHSGKATLIWPLFFLIMFLTIIVCGMVVALSAIRANCHQKPSVCLQAACPESWIGFQRKCFYFSDDTKNWTSSQRFCDSQDAALAQVESFQELNFLLRYKGPSDHWIGLSREQGQPWKWINGTEWTRQFPILGAGEYAYLNDKGASSARYYTERKWICSKPDTYVQMVQQSPN

SEQ ID NO: 919 - protein, 154 aa, Macaca fascicularis
  Cynomolgus CLEC2D construct PEPTIDE (1)..(154)
MSFVSLLLVGILFHATQAQAACPESWIGFQRKCFYFSDDTKNWTSSQRFCDSQDAALAQVESFQELNFLLRYKGPSDHWIGLSREQGQPWKWINGTEWTRQFPILGAGEYAYLNDKGASSARYYTERKWICSKPDTYVQMVQQSPNHHHHHHHH

SEQ ID NO: 920 - protein, 136 aa, Macaca fascicularis
  Cynomolgus CLEC2D construct PEPTIDE (1)..(136)
QAACPESWIGFQRKCFYFSDDTKNWTSSQRFCDSQDAALAQVESFQELNFLLRYKGPSDHWIGLSREQGQPWKWINGTEWTRQFPILGAGEYAYLNDKGASSARYYTERKWICSKPDTYVQMVQQSPNHHHHHHHH

SEQ ID NO: 921 - protein, 225 aa, Homo sapiens
  Human CD161 construct PEPTIDE (1)..(225)
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 922 - protein, 185 aa, Homo sapiens
  Human CD161 construct PEPTIDE (1)..(185)
MSFVSLLLVGILFHATQAQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDSHHHHHHHH

SEQ ID NO: 923 - protein, 167 aa, Homo sapiens
  Human CD161 construct PEPTIDE (1)..(167)
QKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDSHHHHHHHH

SEQ ID NO: 924 - protein, 185 aa, Canis lupus
  Dog CD161 construct PEPTIDE (1)..(185)
MSFVSLLLVGILFHATQAQNSSIEECRVDVQVNGNETTEKPNLLQCPVHWHLLQEKCLFFSHASNTWKDSLTDCSAKESSLLLIQDQEELRLIRGLIYKKEILFWIGLNLTLSEKKWKWINGSFLNSNILQIAGYNKESSCVYISLTGIVSENCDAENQWICQKELKPDRNKICSKFHHHHHHHH

SEQ ID NO: 925 - protein, 167 aa, Canis lupus
  Dog CD161 construct PEPTIDE (1)..(167)
QNSSIEECRVDVQVNGNETTEKPNLLQCPVHWHLLQEKCLFFSHASNTWKDSLTDCSAKESSLLLIQDQEELRLIRGLIYKKEILFWIGLNLTLSEKKWKWINGSFLNSNILQIAGYNKESSCVYISLTGIVSENCDAENQWICQKELKPDRNKICSKFHHHHHHHH

SEQ ID NO: 926 - protein, 187 aa, Macaca fascicularis
  Cynomolgus CD161 construct PEPTIDE (1)..(187)
MSFVSLLLVGILFHATQAQKPSIGKCSVDIQQNRTKTTERPDLLNCPIYWQQVQEKCLLFSHTVNPWNNSLADCSTKESSLLLIQDKDELTRTQNLIHDKAISFWIGLNFSLSEKNWKWINGSFLSSNDLKITGDAKENSCVYISQTSVYSEYCSTEMKWICQKELTLVRNKVSPDSWLHHHHHHHH

SEQ ID NO: 927 - protein, 169 aa, Macaca fascicularis
  Cynomolgus CD161 construct PEPTIDE (1)..(169)
QKPSIGKCSVDIQQNRTKTTERPDLLNCPIYWQQVQEKCLLFSHTVNPWNNSLADCSTKESSLLLIQDKDELTRTQNLIHDKAISFWIGLNFSLSEKNWKWINGSFLSSNDLKITGDAKENSCVYISQTSVYSEYCSTEMKWICQKELTLVRNKVSPDSWLHHHHHHHH

SEQ ID NO: 928 - protein, 166 aa, Mus musculus
  Mouse CD161 construct PEPTIDE (1)..(166)
MSFVSLLLVGILFHATQAQKPSREKCCVFIQENLNKTTDCSVNLECPQDWLLHRDKCFHVSQVSNTWEEGQADCGRKGATLLLIQDQEELRFLLDSIKEKKWINGTTFNSDVLKITGVTENGSCASILGDKVTPESCASDNRWICQKELNHETPSNDSHHHHHHHH

SEQ ID NO: 929 - protein, 165 aa, Mus musculus
  Mouse CD161 construct PEPTIDE (1)..(165)
QKPSREKCCVFIQENLNKTTDCSVNLECPQDWLLHRDKCFHVSQVSNTWEEGQADCGRKGATLLLIQDQEELRFLLDSIKEKYNSFWIGLRFTLPDMNWKWINGTTFNSDVLKITGVTENGSCASILGDKVTPESCASDNRWICQKELNHETPSNDSHHHHHHHH

SEQ ID NO: 930 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGASDHWIGLSREQGQPWKWINGTEWTRQFPILGAGECAYLNDKGASSARCYTERKWICSKSDIHVHHHHHHHH

SEQ ID NO: 931 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGASDHWIGLSREQGQPWKWINGTEWTRQFPILGAGECAYLNDKGASSARCYTERKWICSKSDIHVHHHHHHHH

SEQ ID NO: 932 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPADHWIGLSREQGQPWKWINGTEWTRQFPILGAGECAYLNDKGASSARCYTERKWICSKSDIHVHHHHHHHH

SEQ ID NO: 933 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPADHWIGLSREQGQPWKWINGTEWTRQFPILGAGECAYLNDKGASSARCYTERKWICSKSDIHVHHHHHHHH

SEQ ID NO: 934 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSAHWIGLSREQGQPWKWINGTEWTRQFPILGAGECAYLNDKGASSARCYTERKWICSKSDIHVHHHHHHHH

SEQ ID NO: 935 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSAHWIGLSREQGQPWKWINGTEWTRQFPILGAGECAYLNDKGASSARCYTERKWICSKSDIHVHHHHHHHH

SEQ ID NO: 936 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREAGQPWKWINGTEWTRQFPILGAGECAYLNDKGASSARCYTERKWICSKSDIHVHHHHHHHH

SEQ ID NO: 937 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREAGQPWKWINGTEWTRQFPILGAGECAYLNDKGASSARCYTERKWICSKSDIHVHHHHHHHH

SEQ ID NO: 938 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGACAYLNDKGASSARCYTERKWICSKSDIHVHHHHHHHH

SEQ ID NO: 939 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGACAYLNDKGASSARCYTERKWICSKSDIHVHHHHHHHH

SEQ ID NO: 940 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAALNDKGASSARCYTERKWICSKSDIHVHHHHHHHH

SEQ ID NO: 941 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAALNDKGASSARCYTERKWICSKSDIHVHHHHHHHH

SEQ ID NO: 942 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDAGASSARCYTERKWICSKSDIHVHHHHHHHH

SEQ ID NO: 943 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDAGASSARCYTERKWICSKSDIHVHHHHHHHH

SEQ ID NO: 944 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASAARCYTERKWICSKSDIHVHHHHHHHH

SEQ ID NO: 945 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASAARCYTERKWICSKSDIHVHHHHHHHH

SEQ ID NO: 946 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACYTERKWICSKSDIHVHHHHHHHH

SEQ ID NO: 947 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACYTERKWICSKSDIHVHHHHHHHH

SEQ ID NO: 948 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCATERKWICSKSDIHVHHHHHHHH

SEQ ID NO: 949 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCATERKWICSKSDIHVHHHHHHHH

SEQ ID NO: 950 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYAERKWICSKSDIHVHHHHHHHH

SEQ ID NO: 951 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYAERKWICSKSDIHVHHHHHHHH

SEQ ID NO: 952 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTARKWICSKSDIHVHHHHHHHH

SEQ ID NO: 953 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTARKWICSKSDIHVHHHHHHHH

SEQ ID NO: 954 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTEAKWICSKSDIHVHHHHHHHH

SEQ ID NO: 955 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTEAKWICSKSDIHVHHHHHHHH

SEQ ID NO: 956 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERAWICSKSDIHVHHHHHHHH

SEQ ID NO: 957 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERAWICSKSDIHVHHHHHHHH

SEQ ID NO: 958 - protein, 145 aa, Homo sapiens
  Human CLEC2D construct PEPTIDE (1)..(145)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAALADAGAASARCYTERKWICSKSDIHVHHHHHHH

SEQ ID NO: 959 - protein, 127 aa, Homo sapiens
  Human CLEC2D construct PEPTIDE (1)..(127)
QAACPESWIGFQRKCFYFSDDTKNWTSSQRFCDSQDADLAQVESFQELNFLLRYKGPSDHWIGLSREQGQPWKWINGTEWTRQFPILGAGECAALADAGAASARCYTERKWICSKSDIHVHHHHHHH

SEQ ID NO: 960 - protein, 145 aa, Homo sapiens; identical to SEQ ID NO: 958
  Human CLEC2D construct PEPTIDE (1)..(145)

SEQ ID NO: 961 - protein, 127 aa, Homo sapiens; identical to SEQ ID NO: 959
  Human CLEC2D construct PEPTIDE (1)..(127)

SEQ ID NO: 962 - protein, 146 aa, Homo sapiens
  Human CLEC2D construct PEPTIDE (1)..(146)
MSFVSLLLVGILFHATQAQAACPESWIGFQRKCFYFSDDTKNWTSSQAFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 963 - protein, 128 aa, Homo sapiens
  Human CLEC2D construct PEPTIDE (1)..(128)
QAACPESWIGFQRKCFYFSDDTKNWTSSQAFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 964 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGAPWKWINGTEWTRQFPILGAGECAYLNDKGASSARCYTERKWICSKSDIHVHHHHHHHH

SEQ ID NO: 965 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGAPWKWINGTEWTRQFPILGAGECAYLNDKGASSARCYTERKWICSKSDIHVHHHHHHHH

SEQ ID NO: 966 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTAQFPILGAGECAYLNDKGASSARCYTERKWICSKSDIHVHHHHHHHH

SEQ ID NO: 967 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTAQFPILGAGECAYLNDKGASSARCYTERKWICSKSDIHVHHHHHHHH

SEQ ID NO: 968 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKADIHVHHHHHHHH

SEQ ID NO: 969 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKADIHVHHHHHHHH

SEQ ID NO: 970 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 971 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 972 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACATARKWICSKSDIHVHHHHHHHH

SEQ ID NO: 973 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACATARKWICSKSDIHVHHHHHHHH

SEQ ID NO: 974 - protein, 146 aa, Homo sapiens
  Human CLEC2D construct PEPTIDE (1)..(146)
MSFVSLLLVGILFHATQAQAACPESWIGFQAKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 975 - protein, 128 aa, Homo sapiens
  Human CLEC2D construct PEPTIDE (1)..(128)
QAACPESWIGFQAKCFYFSDDTKNWTSSQRFCDSQDADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 976 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTAWAAAFPILGAGECAYLNDKGASSARCYTERKWICSKSDIHVHHHHHHHH

SEQ ID NO: 977 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTAWAAAFPILGAGECAYLNDKGASSARCYTERKWICSKSDIHVHHHHHHHH

SEQ ID NO: 978 - protein, 146 aa, Homo sapiens
  Human CLEC2D construct PEPTIDE (1)..(146)
MSFVSLLLVGILFHATQAQAACPESWIGFQRKCFYFSDDTKNWTSSQAFCDAQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 979 - protein, 128 aa, Homo sapiens
  Human CLEC2D construct PEPTIDE (1)..(128)
QAACPESWIGFQRKCFYFSDDTKNWTSSQAFCDAQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 980 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQAADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 981 - protein, 128 aa, Homo sapiens
  Human CLEC2D construct PEPTIDE (1)..(128)
QAACPESWIGFQRKCFYFSDDTKNWTSSQRFCDSQAADLAQVESFQELNFLLRYKGPSDHWIGLSREQGQPWKWINGTEWTRQFPILGAGECAYLNDKGASSARCYTERKWICSKSDIAVHHHHHHHH

SEQ ID NO: 982 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGAPWKWINGTEWTAQFPILGAGECAYLNDKGASSARCYTERKWICSKSDIHVHHHHHHHH

SEQ ID NO: 983 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGAPWKWINGTEWTAQFPILGAGECAYLNDKGASSARCYTERKWICSKSDIHVHHHHHHHH

SEQ ID NO: 984 - protein, 146 aa, Homo sapiens
  Human CLEC2D construct PEPTIDE (1)..(146)
MSFVSLLLVGILFHATQAQAACPESWIGFQRKCFYFSDAAANWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 985 - protein, 128 aa, Homo sapiens
  Human CLEC2D construct PEPTIDE (1)..(128)
QAACPESWIGFQRKCFYFSDAAANWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 986 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGAPWAWINGTEWTRQFPILGAGECAYLNDKGASSARCYTERKWICSKSDIHVHHHHHHHH

SEQ ID NO: 987 - protein, 128 aa, Homo sapiens
QAACPESWIGFQRKCFYFSDDTKNWTSSQRFCDSQDADLAQVESFQELNFLLRYKGPSDHWIGLSREQGAPWAWINGTEWTRQFPILGAGECAYLNDKGASSARCYTERKWICSKSDIHVHHHHHHHH

SEQ ID NO: 988 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSRAQGQPWKWINGTEWTRQFPILGAGECAYLNDKGASSARAYTERKWICSKSDIHVHHHHHHHH

SEQ ID NO: 989 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSRAQGQPWKWINGTEWTRQFPILGAGECAYLNDKGASSARAYTERKWICSKSDIHVHHHHHHHH

SEQ ID NO: 990 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSRAAGAPWKWINGTEWTRQFPILGAGECAYLNDKGASSAACYTERKWICSKSDIHVHHHHHHHH

SEQ ID NO: 991 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSRAAGAPWKWINGTEWTRQFPILGAGECAYLNDKGASSAACYTERKWICSKSDIHVHHHHHHHH

SEQ ID NO: 992 - protein, 146 aa, Homo sapiens
  Human CLEC2D construct PEPTIDE (1)..(146)
MSFVSLLLVGILFHATQAQAACPESWIGFQRKCFYFSDATKNWTSSQRFCDSQDADLAQVESFQELNFLLRYKGPSDHWIGLSREQGQPWKWINGTEWTRQFPILGAGECAYLNDKGASSARCATERAWICSKSDIHVHHHHHHHH

SEQ ID NO: 993 - protein, 128 aa, Homo sapiens
  Human CLEC2D construct PEPTIDE (1)..(128)
QAACPESWIGFQRKCFYFSDATKNWTSSQRFCDSQDADLAQVESFQELNFLLRYKGPSDHWIGLSREQGQPWKWINGTEWTRQFPILGAGECAYLNDKGASSARCATERAWICSKSDIHVHHHHHHHH

SEQ ID NO: 994 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESAQELNFLLRYKGPSDHWIGLSREQGQPWKWINGTEWTAQFPILGAGECAYLNDKGASSARCYTERKWICSKSDIHVHHHHHHHH

SEQ ID NO: 995 - protein, 128 aa, Homo sapiens
  Human CLEC2D construct PEPTIDE (1)..(128)
QAACPESWIGFQRKCFYFSDDTKNWTSSQRFCDSQDADLAQVESAQELNFLLRYKGPSDHWIGLSREQGQPWKWINGTEWTAQFPILGAGECAYLNDKGASSARCYTERKWICSKSDIHVHHHHHHHH

SEQ ID NO: 996 - protein, 146 aa, Homo sapiens
  Human CLEC2D construct PEPTIDE (1)..(146)
MSFVSLLLVGILFHATQAQAACPESWIGFQRKCFYFSDDAKAWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 997 - protein, 128 aa, Homo sapiens
  Human CLEC2D construct PEPTIDE (1)..(128)
QAACPESWIGFQRKCFYFSDDAKAWTSSQRFCDSQDADLAQVESFQELNFLLRYKGPSDHWIGLSREQGQPWKWINGTEWTRQFPILGAGECAYLNDKGASSARCYTERKWICSKSDIHVHHHHHHHH

SEQ ID NO: 998 - protein, 146 aa, Homo sapiens
  Human CLEC2D construct PEPTIDE (1)..(146)
MSFVSLLLVGILFHATQAQAACPESWIGFQRKCFYFSDDAKNWTSSQRFCDSQDADLAQVESFQELNFLLRYKGPSDHWIGLSREQGQPWKWINGTEWTRQFPILGAGECAYLNDKGASSARCATARKWICSKSDIHVHHHHHHHH

SEQ ID NO: 999 - protein, 128 aa, Homo sapiens
  Human CLEC2D construct PEPTIDE (1)..(128)
QAACPESWIGFQRKCFYFSDDAKNWTSSQRFCDSQDADLAQVESFQELNFLLRYKGPSDHWIGLSREQGQPWKWINGTEWTRQFPILGAGECAYLNDKGASSARCATARKWICSKSDIHVHHHHHHHH

SEQ ID NO: 1000 - protein, 146 aa, Homo sapiens
  Human CLEC2D construct PEPTIDE (1)..(146)
MSFVSLLLVGILFHATQAQAACPESWIGFQRKCFYFSDDTANWTSSQAFCDSQDADLAQVESFQELNFLLRYKGPSDHWIGLSREQGQPWKWINGTEWTRQFPILGAGECAYLNDKGASSARCYTARKWICSKSDIHVHHHHHHHH

SEQ ID NO: 1001 - protein, 128 aa, Homo sapiens
  Human CLEC2D construct PEPTIDE (1)..(128)
QAACPESWIGFQRKCFYFSDDTANWTSSQAFCDSQDADLAQVESFQELNFLLRYKGPSDHWIGLSREQGQPWKWINGTEWTRQFPILGAGECAYLNDKGASSARCYTARKWICSKSDIHVHHHHHHHH

SEQ ID NO: 1002 - protein, 146 aa, Homo sapiens
  Human CLEC2D construct PEPTIDE (1)..(146)
MSFVSLLLVGILFHATQAQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACATEAKWICSKSDIHVHHHHHHHH

SEQ ID NO: 1003 - protein, 128 aa, Homo sapiens
  Human CLEC2D construct PEPTIDE (1)..(128)
QAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSAACATEAKWICSKSDIHVHHHHHHHH

SEQ ID NO: 1004 - DNA, 36 bp, Artificial Sequence
  chemically synthesized
ggggacagtgtctctagcaacactgctacttggaac

SEQ ID NO: 1005 - DNA, 30 bp, Artificial Sequence
  chemically synthesized
ggattcaccttcagttcccatcttatgcac

SEQ ID NO: 1006 - DNA, 36 bp, Artificial Sequence
  chemically synthesized
ggggacagtgtctctagcggcagtgctgcttggaac

SEQ ID NO: 1007 - DNA, 30 bp, Artificial Sequence
  chemically synthesized
ggttacacctttaccagctacggtatcagc

SEQ ID NO: 1008 - DNA, 30 bp, Artificial Sequence
  chemically synthesized
ggattcaccttcagtagctatgctatacac

SEQ ID NO: 1009 - DNA, 36 bp, Artificial Sequence
  chemically synthesized
gggttctcactcagcactagtggagtgggtgtgggc

SEQ ID NO: 1010 - DNA, 30 bp, Artificial Sequence
  chemically synthesized
ggatacaccttcaccagttctgatatcaac

SEQ ID NO: 1011 - DNA, 30 bp, Artificial Sequence
  chemically synthesized
ggattcaccttcagtagctatgctatgcac

SEQ ID NO: 1012 - DNA, 30 bp, Artificial Sequence
  chemically synthesized
ggattcacctttagcagctatggcatgacg

SEQ ID NO: 1013 - DNA, 30 bp, Artificial Sequence
  chemically synthesized
ggatacaccttcgccgcctattatttacac

SEQ ID NO: 1014 - DNA, 30 bp, Artificial Sequence
  chemically synthesized
ggatacaccttcaccggctactatatgcac

SEQ ID NO: 1015 - DNA, 30 bp, Artificial Sequence
  chemically synthesized
ggatacaccttcaccagttatgatatcaac

SEQ ID NO: 1016 - DNA, 30 bp, Artificial Sequence
  chemically synthesized
ggattcatcttcagtaactatgctatacac

SEQ ID NO: 1017 - DNA, 30 bp, Artificial Sequence
  chemically synthesized
ggattcactttcactgatgcctggatgaac

SEQ ID NO: 1018 - DNA, 30 bp, Artificial Sequence
  chemically synthesized
ggtgggtccgtcagtggttactactggagc

SEQ ID NO: 1019 - DNA, 30 bp, Artificial Sequence
  chemically synthesized
ggattcaacttcagtggatatgaaatgaac

SEQ ID NO: 1020 - DNA, 36 bp, Artificial Sequence
  chemically synthesized
ggggacagtgtctctagcaacagtgttacttggaac

SEQ ID NO: 1021 - DNA, 30 bp, Artificial Sequence
  chemically synthesized
ggattcaccttcagcagctatgctatgcac

SEQ ID NO: 1022 - DNA, 30 bp, Artificial Sequence
  chemically synthesized
ggaatcagcttcagagattactggatgcac

SEQ ID NO: 1023 - DNA, 30 bp, Artificial Sequence
  chemically synthesized
ggatacaccttcactagctatgctatgcat

SEQ ID NO: 1024 - DNA, 30 bp, Artificial Sequence
  chemically synthesized
gggttcaccgtcagtagcaactacatgagc

SEQ ID NO: 1025 - DNA, 30 bp, Artificial Sequence
  chemically synthesized
ggattcacctttagtaacaattggatgacc

SEQ ID NO: 1026 - DNA, 30 bp, Artificial Sequence
  chemically synthesized
gaattcacccttaggaactatggcgtgagc

SEQ ID NO: 1027 - DNA, 30 bp, Artificial Sequence
  chemically synthesized
ggttacacatttaccagttatgccatcagc

SEQ ID NO: 1028 - DNA, 30 bp, Artificial Sequence
  chemically synthesized
ggattcaccttcagtacctatcccatgcac

SEQ ID NO: 1029 - DNA, 30 bp, Artificial Sequence
  chemically synthesized
ggattcacctttgatgattatgccatgcac

SEQ ID NO: 1030 - DNA, 36 bp, Artificial Sequence
  chemically synthesized
ggggacagtgtctctaacaacagggctgcttggaac

SEQ ID NO: 1031 - DNA, 30 bp, Artificial Sequence
  chemically synthesized
ggattcaccttcagtgacccctacatggac

SEQ ID NO: 1032 - DNA, 30 bp, Artificial Sequence
  chemically synthesized
ggattcactttcagtaacgcctggatgagc

SEQ ID NO: 1033 - DNA, 36 bp, Artificial Sequence
  chemically synthesized
ggggacagtgtctctagcaacagtgctgcttggaac

SEQ ID NO: 1034 - DNA, 30 bp, Artificial Sequence
  chemically synthesized
ggattcaccttcagtagctatgctatgcat

SEQ ID NO: 1035 - DNA, 36 bp, Artificial Sequence
  chemically synthesized
ggtggctccatcagcagtggtggttactcctggagc

SEQ ID NO: 1036 - DNA, 36 bp, Artificial Sequence
  chemically synthesized
ggggacagtgtctctggcaacagtgctgcttggaac

SEQ ID NO: 1037 - DNA, 30 bp, Artificial Sequence
  chemically synthesized
ggattcacctttgctgcttataatatcaac

SEQ ID NO: 1038 - DNA, 36 bp, Artificial Sequence
  chemically synthesized
ggggacagtgtctctagcaacaatgctgcttggaac

SEQ ID NO: 1039 - DNA, 30 bp, Artificial Sequence
  chemically synthesized
ggttacacctttaccagctatggtatcagc

SEQ ID NO: 1040 - DNA, 30 bp, Artificial Sequence
  chemically synthesized
ggattcacctttagcagctatgccatgagc

SEQ ID NO: 1041 - DNA, 30 bp, Artificial Sequence
  chemically synthesized
ggattcacctttagcaactatgtcatgagc

SEQ ID NO: 1042 - DNA, 30 bp, Artificial Sequence
  chemically synthesized
ggattcaccttcagcagctctgccatgcac

SEQ ID NO: 1043 - DNA, 30 bp, Artificial Sequence
  chemically synthesized
ggaggcaccttcagcagctatgctatcagc

SEQ ID NO: 1044 - DNA, 30 bp, Artificial Sequence
  chemically synthesized
ggatacagctttaccagctactggatcgcc

SEQ ID NO: 1045 - DNA, 30 bp, Artificial Sequence
  chemically synthesized
cgattcactttcagtgacgcctggatgagc

SEQ ID NO: 1046 - DNA, 30 bp, Artificial Sequence
  chemically synthesized
ggattcaccttcagtacctatggcatgcac

SEQ ID NO: 1047 - DNA, 30 bp, Artificial Sequence
  chemically synthesized
ggattcaccgtcagtagcaactacatgagc

SEQ ID NO: 1048 - DNA, 30 bp, Artificial Sequence
  chemically synthesized
ggattcaccttcagtagctatagcatgaac

SEQ ID NO: 1049 - DNA, 36 bp, Artificial Sequence
  chemically synthesized
ggggacagtgtctctagcgacagtgctgtttggacc

SEQ ID NO: 1050 - DNA, 30 bp, Artificial Sequence
  chemically synthesized
ggattcacctttggtgattatgctatgagc

SEQ ID NO: 1051 - DNA, 30 bp, Artificial Sequence
  chemically synthesized
ggattcaccttcagtagttatagcatgaac

SEQ ID NO: 1052 - DNA, 30 bp, Artificial Sequence
  chemically synthesized
ggatacaccttcactgattatgctatacat

SEQ ID NO: 1053 - DNA, 30 bp, Artificial Sequence
  chemically synthesized
ggtggctccatcagtagttactactggagc

SEQ ID NO: 1054 - DNA, 30 bp, Artificial Sequence
  chemically synthesized
ggattcaccttcagtagctatggcatgcac

SEQ ID NO: 1055 - DNA, 30 bp, Artificial Sequence
  chemically synthesized
ggattcaccttcagtgaccagtacatggac

SEQ ID NO: 1056 - DNA, 30 bp, Artificial Sequence
  chemically synthesized
ggtgggtccttcagtggttactactggagc

SEQ ID NO: 1057 - DNA, 30 bp, Artificial Sequence
  chemically synthesized
ggattcaccttcagcagctatgctatcagc

SEQ ID NO: 1058 - DNA, 30 bp, Artificial Sequence
  chemically synthesized
ggatacaccttcaccagctactatatgcac

SEQ ID NO: 1059 - DNA, 36 bp, Artificial Sequence
  chemically synthesized
ggggacagtgtctctagcaaaagtgctgcttggaac

SEQ ID NO: 1060 - DNA, 30 bp, Artificial Sequence
  chemically synthesized
ggatacagctttaccagctactggatcggc

SEQ ID NO: 1061 - DNA, 30 bp, Artificial Sequence
  chemically synthesized
ggatacaccctcactgaattatccatgcac

SEQ ID NO: 1062 - DNA, 54 bp, Artificial Sequence
  chemically synthesized
aggacatactacaggtccaagtggtataaggataatgcactgtctgtgaaaagt

SEQ ID NO: 1063 - DNA, 51 bp, Artificial Sequence
  chemically synthesized
gttatatcatatgatggaactagtaaatattacggagactccgtgaagggc

SEQ ID NO: 1064 - DNA, 54 bp, Artificial Sequence
  chemically synthesized
aggacatattatagggccaagtggtataatgaatatgcagggtctgtgaaaagc

SEQ ID NO: 1065 - DNA, 51 bp, Artificial Sequence
  chemically synthesized
tggatcagcgcttacaatggtaacacaaactatgcacagaagctccagggc

SEQ ID NO: 1066 - DNA, 48 bp, Artificial Sequence
  chemically synthesized
ctcatttattgggatgatgataagcgctacagcccatctctgaagagc

SEQ ID NO: 1067 - DNA, 51 bp, Artificial Sequence
  chemically synthesized
tggatgaaccctaacagtggtaacaccggctatgcagagaagttccagggc

SEQ ID NO: 1068 - DNA, 51 bp, Artificial Sequence
  chemically synthesized
gttatatcatatgatggaagtaataaatactacgcagactccgtgaagggc

SEQ ID NO: 1069 - DNA, 51 bp, Artificial Sequence
  chemically synthesized
actattagtggtaatggtgttggcacatactacccagactccgtgaaggac

SEQ ID NO: 1070 - DNA, 51 bp, Artificial Sequence
  chemically synthesized
gttatatggtatgatggaagtaataaatactatgcagactccgtgaagggc

SEQ ID NO: 1071 - DNA, 51 bp, Artificial Sequence
  chemically synthesized
cggatcagccctggtaacggtgtcacaagttatgcacagaaatttcagggc

SEQ ID NO: 1072 - DNA, 51 bp, Artificial Sequence
  chemically synthesized
tggatcaaccctaacagtggtggcacaaactatgcacagaagtttcagggc

SEQ ID NO: 1073 - DNA, 51 bp, Artificial Sequence
  chemically synthesized
tggatgaaccctaacagtggtaacacaggctatgcacagaagttccagggc

SEQ ID NO: 1074 - DNA, 57 bp, Artificial Sequence
  chemically synthesized
cgtgttaaaaacaaagctgatggtgagacaacggactacgctgcacccgtcaaaggc

SEQ ID NO: 1075 - DNA, 51 bp, Artificial Sequence
  chemically synthesized
gctattagtggtagtggtggtagcacatactatgcagactccgtgaagggc

SEQ ID NO: 1076 - DNA, 48 bp, Artificial Sequence
  chemically synthesized
gaaatccatcatagtggaagcaccaactacaacccgtccctcaagagt

SEQ ID NO: 1077 - DNA, 51 bp, Artificial Sequence
  chemically synthesized
tacgtcagtactagtggtagtaccagatactacgcagactctgtgaagggc

SEQ ID NO: 1078 - DNA, 54 bp, Artificial Sequence
  chemically synthesized
aggacttactaccggtcccagtggtattataattatgcggtgtctgtgaaaagt

SEQ ID NO: 1079 - DNA, 51 bp, Artificial Sequence
  chemically synthesized
cgtattaatcctgatgggagtagcacaagctacgcggactccgtgaagggc

SEQ ID NO: 1080 - DNA, 51 bp, Artificial Sequence
  chemically synthesized
tggatcaacgctggcaatggtaacacaaaatattcacagaagttccagggc

SEQ ID NO: 1081 - DNA, 48 bp, Artificial Sequence
  chemically synthesized
cttatttatagtgatggtcgcacaaactatgcagactccgtgaagggc

SEQ ID NO: 1082 - DNA, 51 bp, Artificial Sequence
  chemically synthesized
aacataaagcaagatggaactgagaaacactatgtggactctgtgaagggc

SEQ ID NO: 1083 - DNA, 51 bp, Artificial Sequence
  chemically synthesized
ggtatgagtggtagtggttatagtacatactacgcagactccgtgaagggc

SEQ ID NO: 1084 - DNA, 51 bp, Artificial Sequence
  chemically synthesized
gctattagtagtaatgggggtagcacatactacgcagactcagtgaagggc

SEQ ID NO: 1085 - DNA, 51 bp, Artificial Sequence
  chemically synthesized
tggatcagcgcttacgacggtaacacaaactatgcacagaagctccagggc

SEQ ID NO: 1086 - DNA, 51 bp, Artificial Sequence
  chemically synthesized
gttatatcatatgatggacgtaatgaatactacgcagactccgtgaagggc

SEQ ID NO: 1087 - DNA, 51 bp, Artificial Sequence
  chemically synthesized
gctattagtggtagtggtggtagcacatactacgcagactccgtgaagggc

SEQ ID NO: 1088 - DNA, 54 bp, Artificial Sequence
  chemically synthesized
aggacatactacaggtccaagtggtataatgaatatgcagtctctgtgaaaagt

SEQ ID NO: 1089 - DNA, 57 bp, Artificial Sequence
  chemically synthesized
cgaattacaaataagcgtaccggttacgccacaacatatgccgcgtctgtgaaggac

SEQ ID NO: 1090 - DNA, 57 bp, Artificial Sequence
  chemically synthesized
cgtattaaaagcaaaactgatggtgggacaacagactacgctgcacccgtgaaaggc

SEQ ID NO: 1091 - DNA, 54 bp, Artificial Sequence
  chemically synthesized
aggacatactacaggtccaagtggtataatgattatgcagtatctgtgaaaagt

SEQ ID NO: 1092 - DNA, 48 bp, Artificial Sequence
  chemically synthesized
tacatctatcatagtgggagcacctactacaacccgtccctcaagagt

SEQ ID NO: 1093 - DNA, 54 bp, Artificial Sequence
  chemically synthesized
aggacttactacaggtccaagtggtataatgattatgcagtatctctgaaaagt

SEQ ID NO: 1094 - DNA, 57 bp, Artificial Sequence
  chemically synthesized
ttcattagagccaacgctgatagtgggacaacagagtacgccgcgtctgtgaaaggc

SEQ ID NO: 1095 - DNA, 54 bp, Artificial Sequence
  chemically synthesized
aggacatactacaggtccaagtggtataatgattatgcagtatctgtgaagagt

SEQ ID NO: 1096 - DNA, 54 bp, Artificial Sequence
  chemically synthesized
aggacattctacaggtccaagtggtataatgactatgcagtttctgtgaaaagt

SEQ ID NO: 1097 - DNA, 51 bp, Artificial Sequence
  chemically synthesized
tggatcatccctatctttggtatagcaaactacgcacagaagttccagggc

SEQ ID NO: 1098 - DNA, 51 bp, Artificial Sequence
  chemically synthesized
tggatcaacgctggcaatggtaacacaaaatattcagagaagttcgaaggc

SEQ ID NO: 1099 - DNA, 51 bp, Artificial Sequence
  chemically synthesized
tacatcagtagtactagtagtaccatatactacgcagactccgtgaagggc

SEQ ID NO: 1100 - DNA, 51 bp, Artificial Sequence
  chemically synthesized
gctattagtggtattggtgatactacatactacgcggactccgtgaagggc

SEQ ID NO: 1101 - DNA, 54 bp, Artificial Sequence
  chemically synthesized
aggacatattacaggtccaagtggtataatgattatgcagtatctgtgaaaagt

SEQ ID NO: 1102 - DNA, 51 bp, Artificial Sequence
  chemically synthesized
atgatttggcatgatgagagtaagaaatactatgcagactccgtgaagggc

SEQ ID NO: 1103 - DNA, 51 bp, Artificial Sequence
  chemically synthesized
gggatcatccctatctttggtacagcaaactacgcacagaagttccagggc

SEQ ID NO: 1104 - DNA, 51 bp, Artificial Sequence
  chemically synthesized
gtcatctatcctggtgactctgataccagatacagcccgtccttccaaggc

SEQ ID NO: 1105 - DNA, 57 bp, Artificial Sequence
  chemically synthesized
cgtattaaaagcaaaataagtggtgggacaacagactacgctgcacccgtgcaaggc

SEQ ID NO: 1106 - DNA, 51 bp, Artificial Sequence
  chemically synthesized
gctattagtagtaatgggggtagcacatattatgcaaactctgtgaagggc

SEQ ID NO: 1107 - DNA, 51 bp, Artificial Sequence
  chemically synthesized
ggtattagtggtagtggtggtagcacatactacgcagactccgtgaagggc

SEQ ID NO: 1108 - DNA, 51 bp, Artificial Sequence
  chemically synthesized
cttatatcatatgatggaagtaaaaaatactatgcaaactccgtgaagggc

SEQ ID NO: 1109 - DNA, 48 bp, Artificial Sequence
  chemically synthesized
gttatttatagcggtggtagcacatactacgcagactccgtgaagggc

SEQ ID NO: 1110 - DNA, 51 bp, Artificial Sequence
  chemically synthesized
tacattagtagtagtggtagttacacaaactacgcagactctgtgaagggc

SEQ ID NO: 1111 - DNA, 57 bp, Artificial Sequence
  chemically synthesized
cgtattaaaagcaaaactgatggtgagacaacagactacgctgcacccgtgaaaggc

SEQ ID NO: 1112 - DNA, 54 bp, Artificial Sequence
  chemically synthesized
aggacatactacaagtcgaagtggtataatgattatgcagcatctgtgaaaagt

SEQ ID NO: 1113 - DNA, 57 bp, Artificial Sequence
  chemically synthesized
ttcattagaagcaaagcttatggtgggacaacagaatacgccgcgtctgtgaaaggc

SEQ ID NO: 1114 - DNA, 51 bp, Artificial Sequence
  chemically synthesized
tacattagtagtagtggtactaccatatactacgcagactctgtgaagggc

SEQ ID NO: 1115 - DNA, 51 bp, Artificial Sequence
  chemically synthesized
attatatcagatgatggaagtaagagttactacgcagactccgtgcagggc

SEQ ID NO: 1116 - DNA, 51 bp, Artificial Sequence
  chemically synthesized
tggatcaacgctggcgatggtggcacaaaaagttcacgggagttccagggc

SEQ ID NO: 1117 - DNA, 48 bp, Artificial Sequence
  chemically synthesized
tatatctattacactgggagcaccaactacaacccctccctcaagagc

SEQ ID NO: 1118 - DNA, 51 bp, Artificial Sequence
  chemically synthesized
gttatatcatatgatggaagtaataaatactatgcagactccgtgaagggc

SEQ ID NO: 1119 - DNA, 57 bp, Artificial Sequence
  chemically synthesized
cgtgttagaaacaaagctaacagttacaccacagaatacgccgcgtctgtgaaaggc

SEQ ID NO: 1120 - DNA, 48 bp, Artificial Sequence
  chemically synthesized
gaaatcaatcatagtggaagcaccaactacaacccgtccctcaagagt

SEQ ID NO: 1121 - DNA, 51 bp, Artificial Sequence
  chemically synthesized
gggatcatccctatgtatggtacagcaaactacgcacagaagttccagggc

SEQ ID NO: 1122 - DNA, 51 bp, Artificial Sequence
  chemically synthesized
ataatcaaccctagtggtggtagcacaagctacgcacagaagttccagggc

SEQ ID NO: 1123 - DNA, 54 bp, Artificial Sequence
  chemically synthesized
aggacatactacaggtccaaatggaataatgattatgcattatctgtgaaaagt

SEQ ID NO: 1124 - DNA, 51 bp, Artificial Sequence
  chemically synthesized
atcatctatcctggtgactctgataccagatacagcccgtccttccaaggc

SEQ ID NO: 1125 - DNA, 51 bp, Artificial Sequence
  chemically synthesized
tttatatcatatgatggaagtaataaatactacgcagactccgtgaagggc

SEQ ID NO: 1126 - DNA, 51 bp, Artificial Sequence
  chemically synthesized
ggttttgatcctgaagatggtgaaacaatctacgcacagaagttccagggc

SEQ ID NO: 1127 - DNA, 54 bp, Artificial Sequence
  chemically synthesized
gcccggcgggctatgatagggccgcttccgcgacttgtcgggtacttcgatctc

SEQ ID NO: 1128 - DNA, 48 bp, Artificial Sequence
  chemically synthesized
ggccgccccgccccatcctgggttaaaacccgtaactggttcgacccc

SEQ ID NO: 1129 - DNA, 45 bp, Artificial Sequence
  chemically synthesized
ggaggaatgtattactatggttcggggagctcgtactttgactac

SEQ ID NO: 1130 - DNA, 69 bp, Artificial Sequence
  chemically synthesized
aggaaggtgtatgattacgtttgggggagttatcgcctccccgggtcggtatcgtactactttgactac

SEQ ID NO: 1131 - DNA, 45 bp, Artificial Sequence
  chemically synthesized
aaggggggctacgtcggatacagctatggaccttttgggggctac

SEQ ID NO: 1132 - DNA, 30 bp, Artificial Sequence
  chemically synthesized
ggtcgggctggtattgccgcttttgatatc

SEQ ID NO: 1133 - DNA, 19 bp, Artificial Sequence
  chemically synthesized
gcagattataaatatgact

SEQ ID NO: 1134 - DNA, 30 bp, Artificial Sequence
  chemically synthesized
agcagtggctggtcactgcctgaagactac

SEQ ID NO: 1135 - DNA, 39 bp, Artificial Sequence
  chemically synthesized
caagacaaagacaacacgagatattccggtttgggcgtc

SEQ ID NO: 1136 - DNA, 40 bp, Artificial Sequence
  chemically synthesized
gccgcggtgggggatggatacagctatggtcggctcgatt

SEQ ID NO: 1137 - DNA, 33 bp, Artificial Sequence
  chemically synthesized
gatcaggcagctatggtaggctactttgactac

SEQ ID NO: 1138 - DNA, 51 bp, Artificial Sequence
  chemically synthesized
ggccggccatattgtagtagtaccagctgctacccagagtggttcgacccc

SEQ ID NO: 1139 - DNA, 39 bp, Artificial Sequence
  chemically synthesized
agattggatagcagtggccgtggtggttactttgactac

SEQ ID NO: 1140 - DNA, 60 bp, Artificial Sequence
  chemically synthesized
gacaagaacgtccgaaaacatgactacggtgaccacccctacggggggtactttgactac

SEQ ID NO: 1141 - DNA, 54 bp, Artificial Sequence
  chemically synthesized
gagttggtgggtaccagctctccttattactactactactacggtatggacgtc

SEQ ID NO: 1142 - DNA, 27 bp, Artificial Sequence
  chemically synthesized
ggtgggggtgcgagctatactgactcc

SEQ ID NO: 1143 - DNA, 48 bp, Artificial Sequence
  chemically synthesized
tcgagcccctggggggagttatcgttataccagggggcttttgatatc

SEQ ID NO: 1144 - DNA, 27 bp, Artificial Sequence
  chemically synthesized
gtggcgggagctacttccctatggtac

SEQ ID NO: 1145 - DNA, 36 bp, Artificial Sequence
  chemically synthesized
catggtagggccggaataaactggtacttcgatctc

SEQ ID NO: 1146 - DNA, 45 bp, Artificial Sequence
  chemically synthesized
gcgccccctccgactgttggctggtacgcccccgtctttgactac

SEQ ID NO: 1147 - DNA, 30 bp, Artificial Sequence
  chemically synthesized
gactattactatggttcggggagttctccc

SEQ ID NO: 1148 - DNA, 45 bp, Artificial Sequence
  chemically synthesized
gatctgaatcgaggatattgtagtggtggtagctgctttggctac

SEQ ID NO: 1149 - DNA, 36 bp, Artificial Sequence
  chemically synthesized
gcccagccgggcgctgagacgttgaacttcgatctc

SEQ ID NO: 1150 - DNA, 42 bp, Artificial Sequence
  chemically synthesized
ccgggtatggttcggggagttattactgccccgcttgactac

SEQ ID NO: 1151 - DNA, 36 bp, Artificial Sequence
  chemically synthesized
ggggggactatggttcggggtttcggatttaactac

SEQ ID NO: 1152 - DNA, 42 bp, Artificial Sequence
  chemically synthesized
gccacgtattactatgatagtagtggttataggtttgactac

SEQ ID NO: 1153 - DNA, 27 bp, Artificial Sequence
  chemically synthesized
gaggctgccgacgacccgtttgaccat

SEQ ID NO: 1154 - DNA, 48 bp, Artificial Sequence
  chemically synthesized
ggccccggggcagtggctggtactaagccaaagtactactttgactac

SEQ ID NO: 1155 - DNA, 24 bp, Artificial Sequence
  chemically synthesized
gacaagatcggcagctgtccttac

SEQ ID NO: 1156 - DNA, 42 bp, Artificial Sequence
  chemically synthesized
ggaatctatgatagtagtggttcttccaatccctttgactcc

SEQ ID NO: 1157 - DNA, 42 bp, Artificial Sequence
  chemically synthesized
acttttgcggggtatagcagcaaactggggtacttcgatctc

SEQ ID NO: 1158 - DNA, 36 bp, Artificial Sequence
  chemically synthesized
gcccgagtggaatccaaggatgggtactttgactac

SEQ ID NO: 1159 - DNA, 36 bp, Artificial Sequence
  chemically synthesized
gacctgcgactttctacgtgggatgcttatgatttc

SEQ ID NO: 1160 - DNA, 42 bp, Artificial Sequence
  chemically synthesized
ggatcggtatatagtgggagctactatatgctcattgactac

SEQ ID NO: 1161 - DNA, 24 bp, Artificial Sequence
  chemically synthesized
cgggattgggcaggaaaaagggtc

SEQ ID NO: 1162 - DNA, 60 bp, Artificial Sequence
  chemically synthesized
gatggggggtccagcccatactatgatagtagtggtttactaccctggtacttcgatctc

SEQ ID NO: 1163 - DNA, 21 bp, Artificial Sequence
  chemically synthesized
ggcaatgggccgttcgacccc

SEQ ID NO: 1164 - DNA, 36 bp, Artificial Sequence
  chemically synthesized
ggacggactcactggggcccccaggactttgactac

SEQ ID NO: 1165 - DNA, 27 bp, Artificial Sequence
  chemically synthesized
aggggacataactacggtgtagattac

SEQ ID NO: 1166 - DNA, 42 bp, Artificial Sequence
  chemically synthesized
gattattgtagtagtaccagctgccagaactggttcgacccc

SEQ ID NO: 1167 - DNA, 27 bp, Artificial Sequence
  chemically synthesized
tggtacggtgactacggccttgactac

SEQ ID NO: 1168 - DNA, 33 bp, Artificial Sequence
  chemically synthesized
gttacgggacggagagtgggagcccatgactac

SEQ ID NO: 1169 - DNA, 45 bp, Artificial Sequence
  chemically synthesized
ggctccttgtcccgaagtggctggtacgccggactctttgactac

SEQ ID NO: 1170 - DNA, 36 bp, Artificial Sequence
  chemically synthesized
ggggccctacagggcgaatggcggagatttgactac

SEQ ID NO: 1171 - DNA, 24 bp, Artificial Sequence
  chemically synthesized
aacagtcaacgttcgtttgactac

SEQ ID NO: 1172 - DNA, 42 bp, Artificial Sequence
  chemically synthesized
gggccccgaatgtggagcagtggcattgatgcttttgatatc

SEQ ID NO: 1173 - DNA, 36 bp, Artificial Sequence
  chemically synthesized
cgggcgggttacggtgactacagacacttccagcac

SEQ ID NO: 1174 - DNA, 42 bp, Artificial Sequence
  chemically synthesized
catagacgcccaatttacgatattttgactggttttgactac

SEQ ID NO: 1175 - DNA, 54 bp, Artificial Sequence
  chemically synthesized
gatggtacggtccgaagggtagtgggagctactacccctggaaactttgactac

SEQ ID NO: 1176 - DNA, 33 bp, Artificial Sequence
  chemically synthesized
cgggatacacctttggttggggtttcgatatac

SEQ ID NO: 1177 - DNA, 36 bp, Artificial Sequence
  chemically synthesized
gataacgatttttggagtgggaaagtctttgactac

SEQ ID NO: 1178 - DNA, 63 bp, Artificial Sequence
  chemically synthesized
ggccggtcccttccctaccgggggttggctcctagatctttcggaggatactactttgactac

SEQ ID NO: 1179 - DNA, 51 bp, Artificial Sequence
  chemically synthesized
ttgcctagtagtggttatctacaggaccaccactactacggtatggacgtc

SEQ ID NO: 1180 - DNA, 27 bp, Artificial Sequence
  chemically synthesized
gatgtcagtgggtccttcgcggcctac

SEQ ID NO: 1181 - DNA, 15 bp, Artificial Sequence
  chemically synthesized
gacgagtatttctac

SEQ ID NO: 1182 - DNA, 21 bp, Artificial Sequence
  chemically synthesized
gaggctagcagtggctggaac

SEQ ID NO: 1183 - DNA, 30 bp, Artificial Sequence
  chemically synthesized
gagggcggagcagtggctggtactgtctac

SEQ ID NO: 1184 - DNA, 54 bp, Artificial Sequence
  chemically synthesized
gatcggcgttactatgatagtagtggttattatcccgcctactactttgactac

SEQ ID NO: 1185 - DNA, 42 bp, Artificial Sequence
  chemically synthesized
ggcggtacttgggatacagctatggttacgggctttgactac

SEQ ID NO: 1186 - DNA, 24 bp, Artificial Sequence
  chemically synthesized
atagtgggaggtgccgttgactgc

SEQ ID NO: 1187 - DNA, 30 bp, Artificial Sequence
  chemically synthesized
gaggatactatggttcggggagttattccc

SEQ ID NO: 1188 - DNA, 33 bp, Artificial Sequence
  chemically synthesized
ttggcgagtggttccccccctccgggggactac

SEQ ID NO: 1189 - DNA, 45 bp, Artificial Sequence
  chemically synthesized
gttagagtgggagctactactgtttacgacagctggttcgacccc

SEQ ID NO: 1190 - DNA, 33 bp, Artificial Sequence
  chemically synthesized
gatgatcggggtcggggagatgactttgactac

SEQ ID NO: 1191 - DNA, 27 bp, Artificial Sequence
  chemically synthesized
ctagctaattccgacggtgtggacgtc

SEQ ID NO: 1192 - DNA, 42 bp, Artificial Sequence
  chemically synthesized
ggcggtggttcggggagttattataagaggttctttgactac

SEQ ID NO: 1193 - DNA, 36 bp, Artificial Sequence
  chemically synthesized
gggggaagatataccaagggagggtactttgacgac

SEQ ID NO: 1194 - DNA, 39 bp, Artificial Sequence
  chemically synthesized
gaactatacaactatggttcaaaggactactttgactac

SEQ ID NO: 1195 - DNA, 39 bp, Artificial Sequence
  chemically synthesized
gatggccccgccgttgatggtgctgaatacttccagcac

SEQ ID NO: 1196 - DNA, 57 bp, Artificial Sequence
  chemically synthesized
gtcgccaaatattattacgagagtggtggttatcgggcctccaactggttcgacccc

SEQ ID NO: 1197 - DNA, 36 bp, Artificial Sequence
  chemically synthesized
gaagggggcagtggctggcgccactactttgactac

SEQ ID NO: 1198 - DNA, 42 bp, Artificial Sequence
  chemically synthesized
gatcaaggggcagcagctggtaccctggggtactttgactac

SEQ ID NO: 1199 - DNA, 30 bp, Artificial Sequence
  chemically synthesized
gggcgcgtggcgggggatgcttttgatatc

SEQ ID NO: 1200 - DNA, 42 bp, Artificial Sequence
  chemically synthesized
accaaccagggatacggtggtaactccggggtatttgactac

SEQ ID NO: 1201 - DNA, 42 bp, Artificial Sequence
  chemically synthesized
ccccccgacggtggtaactccggtcgctggtacttcgatctc

SEQ ID NO: 1202 - DNA, 39 bp, Artificial Sequence
  chemically synthesized
gcccgggggctacagtacctaatctggtacttcgatctc

SEQ ID NO: 1203 - DNA, 54 bp, Artificial Sequence
  chemically synthesized
gctcgttactatgatagtagtggttatattgccccatcgggttactttgactac

SEQ ID NO: 1204 - DNA, 39 bp, Artificial Sequence
  chemically synthesized
gatggtgtaggagggagagatggctacaattttgactac

SEQ ID NO: 1205 - DNA, 45 bp, Artificial Sequence
  chemically synthesized
ccccattacgatattttgactggttcccgggcgccctttgactac

SEQ ID NO: 1206 - DNA, 15 bp, Artificial Sequence
  chemically synthesized
cgaaacttaggctac

SEQ ID NO: 1207 - DNA, 30 bp, Artificial Sequence
  chemically synthesized
gctaagttttggacatactactttgactac

SEQ ID NO: 1208 - DNA, 36 bp, Artificial Sequence
  chemically synthesized
aaaatagcagcagctggtaagcaacctgttgactac

SEQ ID NO: 1209 - DNA, 30 bp, Artificial Sequence
  chemically synthesized
ggccctatagtgggagcgactatggactac

SEQ ID NO: 1210 - DNA, 33 bp, Artificial Sequence
  chemically synthesized
agaccggatagcagcagtcaatgttttgactac

SEQ ID NO: 1211 - DNA, 33 bp, Artificial Sequence
  chemically synthesized
gcccccctagcagcagatggctactttgactac

SEQ ID NO: 1212 - DNA, 39 bp, Artificial Sequence
  chemically synthesized
gacgggggctatgatagtagtggttttcactttgactac

SEQ ID NO: 1213 - DNA, 27 bp, Artificial Sequence
  chemically synthesized
ggggtgggatggtcgcccttccaatac

SEQ ID NO: 1214 - DNA, 24 bp, Artificial Sequence
  chemically synthesized
ggtgtaacccggacctttgactac

SEQ ID NO: 1215 - DNA, 48 bp, Artificial Sequence
  chemically synthesized
gacgacaaaatagcagcagctggattcacatactggtacttcgatctc

SEQ ID NO: 1216 - DNA, 33 bp, Artificial Sequence
  chemically synthesized
gattatagcagctcgggggagtgctttgactac

SEQ ID NO: 1217 - DNA, 54 bp, Artificial Sequence
  chemically synthesized
ttaaggggtatagattactatgatagtagtggttaccaacgggggtttgactac

SEQ ID NO: 1218 - DNA, 42 bp, Artificial Sequence
  chemically synthesized
gcgccgaggggtgtagtaccagctgctatgcgggggggctac

SEQ ID NO: 1219 - DNA, 45 bp, Artificial Sequence
  chemically synthesized
gacaggggaactaaatggaaccaattgaatgatgtttttgatatg

SEQ ID NO: 1220 - DNA, 45 bp, Artificial Sequence
  chemically synthesized
ggatattgtagtggtggtagctgcccaggaacggattttgactac

SEQ ID NO: 1221 - DNA, 33 bp, Artificial Sequence
  chemically synthesized
ggtgggaggggggatggggccgcttttgacatc

SEQ ID NO: 1222 - DNA, 36 bp, Artificial Sequence
  chemically synthesized
gatttaggggatccccggggtggtattttgaactac

SEQ ID NO: 1223 - DNA, 36 bp, Artificial Sequence
  chemically synthesized
agtctcaatagtgggggctaccgatgcttccatcac

SEQ ID NO: 1224 - DNA, 45 bp, Artificial Sequence
  chemically synthesized
gtaaatccggggagttatacgagggaggtgagcaactttgactac

SEQ ID NO: 1225 - DNA, 30 bp, Artificial Sequence
  chemically synthesized
ctcccggggagagcagctcgtccagactac

SEQ ID NO: 1226 - DNA, 33 bp, Artificial Sequence
  chemically synthesized
gaagctaagtggggaatgtactactttgactac

SEQ ID NO: 1227 - DNA, 42 bp, Artificial Sequence
  chemically synthesized
ggccgagggtatagcagcagtcggctctactactttgactac

SEQ ID NO: 1228 - DNA, 39 bp, Artificial Sequence
  chemically synthesized
ttggtgggcaatagtgggagctactatccgtttgggtac

SEQ ID NO: 1229 - DNA, 24 bp, Artificial Sequence
  chemically synthesized
caagtcgcgggcggtatggacgtc

SEQ ID NO: 1230 - DNA, 27 bp, Artificial Sequence
  chemically synthesized
gggggagggctttgggcttttgatatc

SEQ ID NO: 1231 - DNA, 54 bp, Artificial Sequence
  chemically synthesized
ctcccctcgtattactatgatagtagtggttactttacctggtacttcgatctc

SEQ ID NO: 1232 - DNA, 30 bp, Artificial Sequence
  chemically synthesized
acaggggaccgcttccaagagtttgactac

SEQ ID NO: 1233 - DNA, 39 bp, Artificial Sequence
  chemically synthesized
gatgtgaacccggagctactgggggcgggatttgactac

SEQ ID NO: 1234 - DNA, 33 bp, Artificial Sequence
  chemically synthesized
gccagtcagagtgtcggtaactccttagcctgg

SEQ ID NO: 1235 - DNA, 33 bp, Artificial Sequence
  chemically synthesized
gccagtcagagtataactaactggttggcctgg

SEQ ID NO: 1236 - DNA, 33 bp, Artificial Sequence
  chemically synthesized
gccagtcagactattaatagttggttggcctgg

SEQ ID NO: 1237 - DNA, 33 bp, Artificial Sequence
  chemically synthesized
gcaagtcagggcattagaaatgatttaggctgg

SEQ ID NO: 1238 - DNA, 33 bp, Artificial Sequence
  chemically synthesized
gcaagtcagagcattagcagctatttaaattgg

SEQ ID NO: 1239 - DNA, 51 bp, Artificial Sequence
  chemically synthesized
tccagccagagtgttttatacagctccaacaataagaactacatagcttgg

SEQ ID NO: 1240 - DNA, 33 bp, Artificial Sequence
  chemically synthesized
gccagtcagggcattagcagttctttggcctgg

SEQ ID NO: 1241 - DNA, 36 bp, Artificial Sequence
  chemically synthesized
gccagtgagagtgttaatagcaacttcttagcctgg

SEQ ID NO: 1242 - DNA, 33 bp, Artificial Sequence
  chemically synthesized
gccagtcagagtgttggcagcaaattagcctgg

SEQ ID NO: 1243 - DNA, 36 bp, Artificial Sequence
  chemically synthesized
gccagtcagaatgtttacagcaatttcttagcctgg

SEQ ID NO: 1244 - DNA, 48 bp, Artificial Sequence
  chemically synthesized
tctagtcaaagtctcgaacacggtgatggaaacacgtacttgagttgg

SEQ ID NO: 1245 - DNA, 48 bp, Artificial Sequence
  chemically synthesized
tctagtcagagcctcctgcatagtaatggaaacaactatttggattgg

SEQ ID NO: 1246 - DNA, 33 bp, Artificial Sequence
  chemically synthesized
gccagtcagagtattagcaacaacttagcctgg

SEQ ID NO: 1247 - DNA, 36 bp, Artificial Sequence
  chemically synthesized
gccagtcagagtgttagcagcacctccttagcctgg

SEQ ID NO: 1248 - DNA, 48 bp, Artificial Sequence
  chemically synthesized
tctagtcaaagcctcgtatacagtgatggaaacacctacttgagttgg

SEQ ID NO: 1249 - DNA, 48 bp, Artificial Sequence
  chemically synthesized
tctaatcaaagcctcgtatacagtgatggaggcacctacttgaattgg

SEQ ID NO: 1250 - DNA, 51 bp, Artificial Sequence
  chemically synthesized
tccagccagagtgttttatacagaaccaacaataagaactacttggcttgg

SEQ ID NO: 1251 - DNA, 33 bp, Artificial Sequence
  chemically synthesized
gccagtcagagcattgggagcaatttagcctgg

SEQ ID NO: 1252 - DNA, 48 bp, Artificial Sequence
  chemically synthesized
tctagtcaaagcctcgtgtacagtgatggaaacacctacttgtattgg

SEQ ID NO: 1253 - DNA, 33 bp, Artificial Sequence
  chemically synthesized
gccagtcagagtgttagagacaacgtaggttgg

SEQ ID NO: 1254 - DNA, 36 bp, Artificial Sequence
  chemically synthesized
gccagtcagactattggtcccaagtccttcggctgg

SEQ ID NO: 1255 - DNA, 48 bp, Artificial Sequence
  chemically synthesized
tctagtcagagcctcctgcatagtgatggaaagacctatttgtattgg

SEQ ID NO: 1256 - DNA, 33 bp, Artificial Sequence
  chemically synthesized
gccagtcagagtgttagtagcagcttagcctgg

SEQ ID NO: 1257 - DNA, 33 bp, Artificial Sequence
  chemically synthesized
gccagtgaaggtcttaccaccaacttagcctgg

SEQ ID NO: 1258 - DNA, 33 bp, Artificial Sequence
  chemically synthesized
gccagtcagagtgttagcaccctcttagcctgg

SEQ ID NO: 1259 - DNA, 36 bp, Artificial Sequence
  chemically synthesized
gccagtcagagtgttttcaacaactacttagcctgg

SEQ ID NO: 1260 - DNA, 48 bp, Artificial Sequence
  chemically synthesized
tctagtcaaagcctcgtatacagtgatggaaacacctacttgaattgg

SEQ ID NO: 1261 - DNA, 48 bp, Artificial Sequence
  chemically synthesized
tctagtcagagcctcctacatagtagtggatacaactatttggattgg

SEQ ID NO: 1262 - DNA, 48 bp, Artificial Sequence
  chemically synthesized
tctagtcagagcctcctgaatagtaatggatacaactatttggagtgg

SEQ ID NO: 1263 - DNA, 36 bp, Artificial Sequence
  chemically synthesized
gccagtcagagtgttaccagcaactacttagcctgg

SEQ ID NO: 1264 - DNA, 36 bp, Artificial Sequence
  chemically synthesized
gccagtcagagtgttagcagcagctccttagcctgg

SEQ ID NO: 1265 - DNA, 33 bp, Artificial Sequence
  chemically synthesized
gccagtcagagtattggcagcaacttagtctgg

SEQ ID NO: 1266 - DNA, 48 bp, Artificial Sequence
  chemically synthesized
tctagtcaaagcctcgaacacactgatggaaacacctacttaagttgg

SEQ ID NO: 1267 - DNA, 33 bp, Artificial Sequence
  chemically synthesized
gcaagtcagagcattagcaactatttaaattgg

SEQ ID NO: 1268 - DNA, 33 bp, Artificial Sequence
  chemically synthesized
ccaagtcaggacataggcacttatttaaattgg

SEQ ID NO: 1269 - DNA, 33 bp, Artificial Sequence
  chemically synthesized
gccagtcaaagtgttaacagcaacgtagcctgg

SEQ ID NO: 1270 - DNA, 33 bp, Artificial Sequence
  chemically synthesized
gccagtcagagtgttggtaccaatttagcctgg

SEQ ID NO: 1271 - DNA, 33 bp, Artificial Sequence
  chemically synthesized
gccagtcagagtattagtaggtggttggcctgg

SEQ ID NO: 1272 - DNA, 33 bp, Artificial Sequence
  chemically synthesized
gcgagtcagaacattcgccactggttagtctgg

SEQ ID NO: 1273 - DNA, 51 bp, Artificial Sequence
  chemically synthesized
tccagccggaatattttatacagcggcaacaataaaaacttcttggcttgg

SEQ ID NO: 1274 - DNA, 36 bp, Artificial Sequence
  chemically synthesized
gccagtcagagtattagcagcacctacttagcctgg

SEQ ID NO: 1275 - DNA, 33 bp, Artificial Sequence
  chemically synthesized
gccaggcagagcatcagtaaccggttggcctgg

SEQ ID NO: 1276 - DNA, 36 bp, Artificial Sequence
  chemically synthesized
gccagtgagagtgttagcaagagctacttactctgg

SEQ ID NO: 1277 - DNA, 36 bp, Artificial Sequence
  chemically synthesized
gccagtcagagtgttagcagcagcgccttagcctgg

SEQ ID NO: 1278 - DNA, 33 bp, Artificial Sequence
  chemically synthesized
gccagtcaaagtgttaccagcaacttagcctgg

SEQ ID NO: 1279 - DNA, 33 bp, Artificial Sequence
  chemically synthesized
gccagtcagagtattggcacttacgtcgcctgg

SEQ ID NO: 1280 - DNA, 36 bp, Artificial Sequence
  chemically synthesized
gccagtcagagtgttagcagcaactccttagcctgg

SEQ ID NO: 1281 - DNA, 51 bp, Artificial Sequence
  chemically synthesized
tccagccagagtgttttatatgattccaacagtaagaactacttaagttgg

SEQ ID NO: 1282 - DNA, 33 bp, Artificial Sequence
  chemically synthesized
gccagtcagagtgttagtagctacttagcctgg

SEQ ID NO: 1283 - DNA, 48 bp, Artificial Sequence
  chemically synthesized
tcttgtcaaagcctcgtatacagtgatggcaacacctacttgaattgc

SEQ ID NO: 1284 - DNA, 36 bp, Artificial Sequence
  chemically synthesized
gccagtcagagtgttagcagcagctacttaggctgg

SEQ ID NO: 1285 - DNA, 33 bp, Artificial Sequence
  chemically synthesized
gccagtcagagcattggtggtagcttacactgg

SEQ ID NO: 1286 - DNA, 51 bp, Artificial Sequence
  chemically synthesized
tccagccagagtgttttatacagctccaacaataagaactacttagcttgg

SEQ ID NO: 1287 - DNA, 33 bp, Artificial Sequence
  chemically synthesized
gccagtcagagtattagcagcaacttagcctgg

SEQ ID NO: 1288 - DNA, 48 bp, Artificial Sequence
  chemically synthesized
tctagtcatagcctcacaactactgatggacgtacttacgtggcttgg

SEQ ID NO: 1289 - DNA, 48 bp, Artificial Sequence
  chemically synthesized
tctagtcagagcctcctgggtggtgatggaaagacctatttgtattgg

SEQ ID NO: 1290 - DNA, 33 bp, Artificial Sequence
  chemically synthesized
gcgagtcagggcattgccaattatttagcctgg

SEQ ID NO: 1291 - DNA, 33 bp, Artificial Sequence
  chemically synthesized
gccagtcagagtattactacctggttggcctgg

SEQ ID NO: 1292 - DNA, 33 bp, Artificial Sequence
  chemically synthesized
gccagtcagagtattagtagctggttggcctgg

SEQ ID NO: 1293 - DNA, 36 bp, Artificial Sequence
  chemically synthesized
gccagtcagagtgttaatagcggctacttagcctgg

SEQ ID NO: 1294 - DNA, 36 bp, Artificial Sequence
  chemically synthesized
gccagtcacagtgttggcgccaactacatagcctgg

SEQ ID NO: 1295 - DNA, 48 bp, Artificial Sequence
  chemically synthesized
tctagtcagagcctcctgcatagtaatggatacaactatttggattgg

SEQ ID NO: 1296 - DNA, 33 bp, Artificial Sequence
  chemically synthesized
gccagtcagagtgttagcagcaacttagcctgg

SEQ ID NO: 1297 - DNA, 36 bp, Artificial Sequence
  chemically synthesized
gccagtcagagtgtaataagcaggtacttagcctgg

SEQ ID NO: 1298 - DNA, 48 bp, Artificial Sequence
  chemically synthesized
tctagtcaaagcctcgtacacagtaatggacacacctacttgagttgg

SEQ ID NO: 1299 - DNA, 36 bp, Artificial Sequence
  chemically synthesized
gccagtcagagtgttagcagcagctacttagcctgg

SEQ ID NO: 1300 - DNA, 33 bp, Artificial Sequence
  chemically synthesized
gccagtcagagtttaagtaccaacttagcctgg

SEQ ID NO: 1301 - DNA, 36 bp, Artificial Sequence
  chemically synthesized
gccagtcagagtattagcggcagttacttagcctgg

SEQ ID NO: 1302 - DNA, 36 bp, Artificial Sequence
  chemically synthesized
gccagtcagagtcttaccagcagctacttagcctgg

SEQ ID NO: 1303 - DNA, 51 bp, Artificial Sequence
  chemically synthesized
tccagccaggccctgcgaaatgttgtcggccttggcgatgatttagcctgg

SEQ ID NO: 1304 - DNA, 51 bp, Artificial Sequence
  chemically synthesized
tccaaccggagtgttttatacagccccaacaatcagaactacttaggttgg

SEQ ID NO: 1305 - DNA, 33 bp, Artificial Sequence
  chemically synthesized
gccagtcagagtgttagcagctacttagcctgg

SEQ ID NO: 1306 - DNA, 33 bp, Artificial Sequence
  chemically synthesized
gccagtcagagtgttggcagcgacttagcctgg

SEQ ID NO: 1307 - DNA, 33 bp, Artificial Sequence
  chemically synthesized
gccagtcagagtattagtagctgcttggcctgg

SEQ ID NO: 1308 - DNA, 24 bp, Artificial Sequence
  chemically synthesized
ggtgcgtccagtttgcagagtggg

SEQ ID NO: 1309 - DNA, 24 bp, Artificial Sequence
  chemically synthesized
agggcgtctcgtttagaaagtggg

SEQ ID NO: 1310 - DNA, 24 bp, Artificial Sequence
  chemically synthesized
ggtgcttccaccagggccactggc

SEQ ID NO: 1311 - DNA, 24 bp, Artificial Sequence
  chemically synthesized
ggtgcatccagtttgcaaagtgga

SEQ ID NO: 1312 - DNA, 24 bp, Artificial Sequence
  chemically synthesized
gctgcatccagtttgcacactggg

SEQ ID NO: 1313 - DNA, 24 bp, Artificial Sequence
  chemically synthesized
gctgcatccactttgcaaagtggg

SEQ ID NO: 1314 - DNA, 24 bp, Artificial Sequence
  chemically synthesized
gctgcatccaccagggccactggt

SEQ ID NO: 1315 - DNA, 24 bp, Artificial Sequence
  chemically synthesized
ggtgcctccagcagggccgctggc

SEQ ID NO: 1316 - DNA, 24 bp, Artificial Sequence
  chemically synthesized
gctgcatcctacagggccactggc

SEQ ID NO: 1317 - DNA, 24 bp, Artificial Sequence
  chemically synthesized
aaggtttctaaccggttgtctggg

SEQ ID NO: 1318 - DNA, 24 bp, Artificial Sequence
  chemically synthesized
gatgcatccaccagggccactggt

SEQ ID NO: 1319 - DNA, 24 bp, Artificial Sequence
  chemically synthesized
ggtacatccaccagggccactggt

SEQ ID NO: 1320 - DNA, 24 bp, Artificial Sequence
  chemically synthesized
ggtgcatccaggagggccactggc

SEQ ID NO: 1321 - DNA, 24 bp, Artificial Sequence
  chemically synthesized
aagatttctaaccggttctctggg

SEQ ID NO: 1322 - DNA, 24 bp, Artificial Sequence
  chemically synthesized
gatgcatccaccagggccacggga

SEQ ID NO: 1323 - DNA, 24 bp, Artificial Sequence
  chemically synthesized
aaggtttctaagcgggactctggg

SEQ ID NO: 1324 - DNA, 21 bp, Artificial Sequence
  chemically synthesized
gactccaacagggccactggc

SEQ ID NO: 1325 - DNA, 24 bp, Artificial Sequence
  chemically synthesized
gaagtttccaaccggttctctgga

SEQ ID NO: 1326 - DNA, 24 bp, Artificial Sequence
  chemically synthesized
ggtgcctccaccagggccactgct

SEQ ID NO: 1327 - DNA, 24 bp, Artificial Sequence
  chemically synthesized
gctgcctccaccagggccactggt

SEQ ID NO: 1328 - DNA, 24 bp, Artificial Sequence
  chemically synthesized
ttgggttctaatcgggcctccggg

SEQ ID NO: 1329 - DNA, 24 bp, Artificial Sequence
  chemically synthesized
ggtgcatcctacagggccactggc

SEQ ID NO: 1330 - DNA, 24 bp, Artificial Sequence
  chemically synthesized
agtgcaacctctagggccactgga

SEQ ID NO: 1331 - DNA, 24 bp, Artificial Sequence
  chemically synthesized
aaggtttctacccggttctctggg

SEQ ID NO: 1332 - DNA, 24 bp, Artificial Sequence
  chemically synthesized
gctgcatccagtttgcaaagtggg

SEQ ID NO: 1333 - DNA, 24 bp, Artificial Sequence
  chemically synthesized
gctgcctccaatctgcacagtggc

SEQ ID NO: 1334 - DNA, 24 bp, Artificial Sequence
  chemically synthesized
gatgtatccaccagggccactgat

SEQ ID NO: 1335 - DNA, 24 bp, Artificial Sequence
  chemically synthesized
aaggcgtctactataaaaagtggg

SEQ ID NO: 1336 - DNA, 24 bp, Artificial Sequence
  chemically synthesized
gctgcgtccaatttgcaaagtggg

SEQ ID NO: 1337 - DNA, 24 bp, Artificial Sequence
  chemically synthesized
tgggcatctacccgggaatccggg

SEQ ID NO: 1338 - DNA, 24 bp, Artificial Sequence
  chemically synthesized
ggtgcatccaccagggccactggc

SEQ ID NO: 1339 - DNA, 24 bp, Artificial Sequence
  chemically synthesized
aaggcgtctactttagcaaatggg

SEQ ID NO: 1340 - DNA, 24 bp, Artificial Sequence
  chemically synthesized
ggtgcatccaccagggccagtggc

SEQ ID NO: 1341 - DNA, 24 bp, Artificial Sequence
  chemically synthesized
gattcatccagcagggccactggc

SEQ ID NO: 1342 - DNA, 24 bp, Artificial Sequence
  chemically synthesized
ggtgcatccaacagggccactggt

SEQ ID NO: 1343 - DNA, 24 bp, Artificial Sequence
  chemically synthesized
gatgcatccagcagggccactggc

SEQ ID NO: 1344 - DNA, 24 bp, Artificial Sequence
  chemically synthesized
gattcatcgaatagggccactggc

SEQ ID NO: 1345 - DNA, 24 bp, Artificial Sequence
  chemically synthesized
ggtgcatccagcagggcctctggc

SEQ ID NO: 1346 - DNA, 24 bp, Artificial Sequence
  chemically synthesized
tgggcgtctacccgggggtccggg

SEQ ID NO: 1347 - DNA, 24 bp, Artificial Sequence
  chemically synthesized
aaggtttctaaccgggactctggg

SEQ ID NO: 1348 - DNA, 24 bp, Artificial Sequence
  chemically synthesized
ggtgcatccagcagggccactgac

SEQ ID NO: 1349 - DNA, 24 bp, Artificial Sequence
  chemically synthesized
tatgcttcccagtccttctcaggg

SEQ ID NO: 1350 - DNA, 24 bp, Artificial Sequence
  chemically synthesized
tgggcatctgcccgggaatccggg

SEQ ID NO: 1351 - DNA, 24 bp, Artificial Sequence
  chemically synthesized
ggtgcctccaccagggccactggt

SEQ ID NO: 1352 - DNA, 24 bp, Artificial Sequence
  chemically synthesized
gaggtttctaagcgggactctggg

SEQ ID NO: 1353 - DNA, 24 bp, Artificial Sequence
  chemically synthesized
gaagtttccaaccgattctctgga

SEQ ID NO: 1354 - DNA, 24 bp, Artificial Sequence
  chemically synthesized
gcttcatctactttgcaatcaggg

SEQ ID NO: 1355 - DNA, 24 bp, Artificial Sequence
  chemically synthesized
aaggcctctagtttaacaagtggg

SEQ ID NO: 1356 - DNA, 24 bp, Artificial Sequence
  chemically synthesized
aaggcgtctagtttagaaagtggg

SEQ ID NO: 1357 - DNA, 24 bp, Artificial Sequence
  chemically synthesized
ttgggttctactcgggcctccggg

SEQ ID NO: 1358 - DNA, 24 bp, Artificial Sequence
  chemically synthesized
ggtgtttccaccagggccactggc

SEQ ID NO: 1359 - DNA, 24 bp, Artificial Sequence
  chemically synthesized
actgcatccaaaagggccactggc

SEQ ID NO: 1360 - DNA, 24 bp, Artificial Sequence
  chemically synthesized
atgggttctagtcgggcctccggg

SEQ ID NO: 1361 - DNA, 24 bp, Artificial Sequence
  chemically synthesized
ggtgcatccagcagggccactggc

SEQ ID NO: 1362 - DNA, 24 bp, Artificial Sequence
  chemically synthesized
ggtgcatccaccagggccactggt

SEQ ID NO: 1363 - DNA, 24 bp, Artificial Sequence
  chemically synthesized
gaggtttctaaccgggactctggt

SEQ ID NO: 1364 - DNA, 24 bp, Artificial Sequence
  chemically synthesized
ggcgcatccaacagggccacaggc

SEQ ID NO: 1365 - DNA, 24 bp, Artificial Sequence
  chemically synthesized
gatgcgtccagcagggccgaaggc

SEQ ID NO: 1366 - DNA, 24 bp, Artificial Sequence
  chemically synthesized
cgtgcatccagcagggccactggc

SEQ ID NO: 1367 - DNA, 24 bp, Artificial Sequence
  chemically synthesized
tctacatcgactttacaaagtgga

SEQ ID NO: 1368 - DNA, 24 bp, Artificial Sequence
  chemically synthesized
tgggcatctacccgggactccggg

SEQ ID NO: 1369 - DNA, 24 bp, Artificial Sequence
  chemically synthesized
gatgcatccaacagggccactggc

SEQ ID NO: 1370 - DNA, 24 bp, Artificial Sequence
  chemically synthesized
cgtgcatccaccagggccgctggt

SEQ ID NO: 1371 - DNA, 24 bp, Artificial Sequence
  chemically synthesized
gatgcatccaatttggaaacaggg

SEQ ID NO: 1372 - DNA, 24 bp, Artificial Sequence
  chemically synthesized
ttgggttctaatcgggcccccggg

SEQ ID NO: 1373 - DNA, 30 bp, Artificial Sequence
  chemically synthesized
caacgtggcacctggcctcccctcactttc

SEQ ID NO: 1374 - DNA, 27 bp, Artificial Sequence
  chemically synthesized
cagtatactaattaccctcgtacgttc

SEQ ID NO: 1375 - DNA, 27 bp, Artificial Sequence
  chemically synthesized
caaagtatacagcttccgtggacgttc

SEQ ID NO: 1376 - DNA, 27 bp, Artificial Sequence
  chemically synthesized
caatataatagttattctcccactttt

SEQ ID NO: 1377 - DNA, 30 bp, Artificial Sequence
  chemically synthesized
cactatggtccctcacgtcggatcaccttc

SEQ ID NO: 1378 - DNA, 27 bp, Artificial Sequence
  chemically synthesized
cagcataattcctaccctcgaacattc

SEQ ID NO: 1379 - DNA, 27 bp, Artificial Sequence
  chemically synthesized
cagagttacagtattcctcgaacgttc

SEQ ID NO: 1380 - DNA, 27 bp, Artificial Sequence
  chemically synthesized
caatattattatattcctcggacgttc

SEQ ID NO: 1381 - DNA, 30 bp, Artificial Sequence
  chemically synthesized
cagtatggtagctcatccatgtacactttt

SEQ ID NO: 1382 - DNA, 30 bp, Artificial Sequence
  chemically synthesized
cagtatgataatctccctcctctcactttc

SEQ ID NO: 1383 - DNA, 27 bp, Artificial Sequence
  chemically synthesized
cagtataataactggccgctcactttc

SEQ ID NO: 1384 - DNA, 27 bp, Artificial Sequence
  chemically synthesized
cagtataatagttattcggggacgttc

SEQ ID NO: 1385 - DNA, 30 bp, Artificial Sequence
  chemically synthesized
cagtataataactggcccccgatcaccttc

SEQ ID NO: 1386 - DNA, 27 bp, Artificial Sequence
  chemically synthesized
caatatggaacctcaccgatcaccttc

SEQ ID NO: 1387 - DNA, 30 bp, Artificial Sequence
  chemically synthesized
cagtataataactggcctcccatcaccttc

SEQ ID NO: 1388 - DNA, 27 bp, Artificial Sequence
  chemically synthesized
caaggtatatactggcctcgaaccttc

SEQ ID NO: 1389 - DNA, 27 bp, Artificial Sequence
  chemically synthesized
cagcgtagcaactggtcgctcactttc

SEQ ID NO: 1390 - DNA, 27 bp, Artificial Sequence
  chemically synthesized
caaggtctacaaatccctatcactttc

SEQ ID NO: 1391 - DNA, 27 bp, Artificial Sequence
  chemically synthesized
cactataataactggcctcataccttc

SEQ ID NO: 1392 - DNA, 18 bp, Artificial Sequence
  chemically synthesized
cagtatggtagctcgttc

SEQ ID NO: 1393 - DNA, 30 bp, Artificial Sequence
  chemically synthesized
cagtataatttctggccttcgatcaccttc

SEQ ID NO: 1394 - DNA, 30 bp, Artificial Sequence
  chemically synthesized
cactatggtagttcacctccaatcaccttc

SEQ ID NO: 1395 - DNA, 27 bp, Artificial Sequence
  chemically synthesized
caaggtacacaatttcctcaaacgttc

SEQ ID NO: 1396 - DNA, 27 bp, Artificial Sequence
  chemically synthesized
caagggacacactggccgtacactttt

SEQ ID NO: 1397 - DNA, 27 bp, Artificial Sequence
  chemically synthesized
caatattacaatcttcctcgatctttt

SEQ ID NO: 1398 - DNA, 24 bp, Artificial Sequence
  chemically synthesized
cagcatggtgaatggcccaccttc

SEQ ID NO: 1399 - DNA, 27 bp, Artificial Sequence
  chemically synthesized
caaggtagacactggccgtacactctt

SEQ ID NO: 1400 - DNA, 27 bp, Artificial Sequence
  chemically synthesized
cagtttaataattggccttacactttt

SEQ ID NO: 1401 - DNA, 27 bp, Artificial Sequence
  chemically synthesized
cagcgtagcaggtggcctctcactttc

SEQ ID NO: 1402 - DNA, 27 bp, Artificial Sequence
  chemically synthesized
caaagtatacagcttccgctcactttc

SEQ ID NO: 1403 - DNA, 30 bp, Artificial Sequence
  chemically synthesized
cagtatggtagctcacccccgggcactttc

SEQ ID NO: 1404 - DNA, 27 bp, Artificial Sequence
  chemically synthesized
cgctatgataactggcctccccttttt

SEQ ID NO: 1405 - DNA, 30 bp, Artificial Sequence
  chemically synthesized
cagtataatcactggcctctctacactttt

SEQ ID NO: 1406 - DNA, 27 bp, Artificial Sequence
  chemically synthesized
cagggtagcaactggccgctcactttc

SEQ ID NO: 1407 - DNA, 27 bp, Artificial Sequence
  chemically synthesized
caaggtacacactggcctcgaacgttc

SEQ ID NO: 1408 - DNA, 27 bp, Artificial Sequence
  chemically synthesized
caccgttacgtgtggccgttcactttc

SEQ ID NO: 1409 - DNA, 27 bp, Artificial Sequence
  chemically synthesized
cagtatggtagttcaccgatcaccttc

SEQ ID NO: 1410 - DNA, 27 bp, Artificial Sequence
  chemically synthesized
caaggtacacattggcctcggactttc

SEQ ID NO: 1411 - DNA, 27 bp, Artificial Sequence
  chemically synthesized
caaggtctacaaattccgctcactttc

SEQ ID NO: 1412 - DNA, 27 bp, Artificial Sequence
  chemically synthesized
cagtctctacaaactcctctcactttc

SEQ ID NO: 1413 - DNA, 24 bp, Artificial Sequence
  chemically synthesized
cagtatgctagctcagtcaccttc

SEQ ID NO: 1414 - DNA, 30 bp, Artificial Sequence
  chemically synthesized
cagtataataactggcctcccttcaccttc

SEQ ID NO: 1415 - DNA, 24 bp, Artificial Sequence
  chemically synthesized
cagtatggtagctcacagaccttc

SEQ ID NO: 1416 - DNA, 30 bp, Artificial Sequence
  chemically synthesized
cagtatggtagttcacctccgaccaccttc

SEQ ID NO: 1417 - DNA, 27 bp, Artificial Sequence
  chemically synthesized
cagcgtagcaactggccgtggacgttc

SEQ ID NO: 1418 - DNA, 27 bp, Artificial Sequence
  chemically synthesized
caggctacacactatcctcggacgttc

SEQ ID NO: 1419 - DNA, 27 bp, Artificial Sequence
  chemically synthesized
cagagttacattaccccgtggacgttc

SEQ ID NO: 1420 - DNA, 24 bp, Artificial Sequence
  chemically synthesized
cagagttacggtcctcggacattc

SEQ ID NO: 1421 - DNA, 30 bp, Artificial Sequence
  chemically synthesized
cagtgtgctagctcacctcctgtcactttc

SEQ ID NO: 1422 - DNA, 30 bp, Artificial Sequence
  chemically synthesized
cagtataataactggcctccgataactttc

SEQ ID NO: 1423 - DNA, 27 bp, Artificial Sequence
  chemically synthesized
cactataaaagtgattcccggacgttc

SEQ ID NO: 1424 - DNA, 27 bp, Artificial Sequence
  chemically synthesized
cagcataacagttacccgtggacgttc

SEQ ID NO: 1425 - DNA, 27 bp, Artificial Sequence
  chemically synthesized
caatattatagtactccgctcactttc

SEQ ID NO: 1426 - DNA, 24 bp, Artificial Sequence
  chemically synthesized
cagtatggtagctcactcctcttc

SEQ ID NO: 1427 - DNA, 27 bp, Artificial Sequence
  chemically synthesized
cagagtagtagtttacctcacactttc

SEQ ID NO: 1428 - DNA, 33 bp, Artificial Sequence
  chemically synthesized
cagtatggtaactcacctccgggagccaccttc

SEQ ID NO: 1429 - DNA, 24 bp, Artificial Sequence
  chemically synthesized
cagtatcaaagttactggacgttc

SEQ ID NO: 1430 - DNA, 24 bp, Artificial Sequence
  chemically synthesized
cactatggcagctctcgcaccttc

SEQ ID NO: 1431 - DNA, 27 bp, Artificial Sequence
  chemically synthesized
cagtttaatacctaccccaacactttt

SEQ ID NO: 1432 - DNA, 30 bp, Artificial Sequence
  chemically synthesized
cagtatggtagctcacctgcgctcactttc

SEQ ID NO: 1433 - DNA, 30 bp, Artificial Sequence
  chemically synthesized
cagtatggtagtccacctccgaccaccttc

SEQ ID NO: 1434 - DNA, 30 bp, Artificial Sequence
  chemically synthesized
cagtatggtagctcacctcgggtcactttc

SEQ ID NO: 1435 - DNA, 27 bp, Artificial Sequence
  chemically synthesized
cagcgtgccgagtggcctctcaccttc

SEQ ID NO: 1436 - DNA, 27 bp, Artificial Sequence
  chemically synthesized
cagtatggtagctcacgtcggacgttc

SEQ ID NO: 1437 - DNA, 27 bp, Artificial Sequence
  chemically synthesized
cagtatggtagctcagggtacactttt

SEQ ID NO: 1438 - DNA, 24 bp, Artificial Sequence
  chemically synthesized
cagtatggtaactcacagaccttc

SEQ ID NO: 1439 - DNA, 24 bp, Artificial Sequence
  chemically synthesized
caattttatggtattccccacttc

SEQ ID NO: 1440 - DNA, 27 bp, Artificial Sequence
  chemically synthesized
aagtataacagtccccctcggacgttc

SEQ ID NO: 1441 - DNA, 27 bp, Artificial Sequence
  chemically synthesized
caaggtctacaaactccattcactttc

SEQ ID NO: 1442 - DNA, 24 bp, Artificial Sequence
  chemically synthesized
cagcgtagcaactggcctttcttc

SEQ ID NO: 1443 - DNA, 27 bp, Artificial Sequence
  chemically synthesized
cagtatggtatctcacctctcgcgttc

SEQ ID NO: 1444 - DNA, 27 bp, Artificial Sequence
  chemically synthesized
cagagtatcagtttaccgctcactttc

SEQ ID NO: 1445 - DNA, 27 bp, Artificial Sequence
  chemically synthesized
caattttatagtcctcctcggacgttc

SEQ ID NO: 1446 - DNA, 27 bp, Artificial Sequence
  chemically synthesized
cagtataataactggcctagaacgttc

SEQ ID NO: 1447 - DNA, 27 bp, Artificial Sequence
  chemically synthesized
caaggaacacatgggcctcacacgttc

SEQ ID NO: 1448 - DNA, 27 bp, Artificial Sequence
  chemically synthesized
caatctacacaatttccgtggacgttc

SEQ ID NO: 1449 - DNA, 27 bp, Artificial Sequence
  chemically synthesized
aagtataacagtgtccctctcactttc

SEQ ID NO: 1450 - DNA, 27 bp, Artificial Sequence
  chemically synthesized
cattataatggtgcttctcgtatgttc

SEQ ID NO: 1451 - DNA, 24 bp, Artificial Sequence
  chemically synthesized
cagtataatagttattggacgttc

SEQ ID NO: 1452 - DNA, 27 bp, Artificial Sequence
  chemically synthesized
caagctctacacactccgtggacgttc

SEQ ID NO: 1453 - DNA, 27 bp, Artificial Sequence
  chemically synthesized
cagtataatagttattcaaggacgttc

SEQ ID NO: 1454 - DNA, 30 bp, Artificial Sequence
  chemically synthesized
cagtatggtagctcactcaggtacactttt

SEQ ID NO: 1455 - DNA, 24 bp, Artificial Sequence
  chemically synthesized
cagtataataactggcctcggttc

SEQ ID NO: 1456 - DNA, 30 bp, Artificial Sequence
  chemically synthesized
gagtatggtaactcagctatgtacaatttt

SEQ ID NO: 1457 - DNA, 27 bp, Artificial Sequence
  chemically synthesized
cagtataataactggcctctcactttc

SEQ ID NO: 1458 - DNA, 27 bp, Artificial Sequence
  chemically synthesized
cagtatgctgccgcaccgattaccttc

SEQ ID NO: 1459 - DNA, 24 bp, Artificial Sequence
  chemically synthesized
caaactttacacactgtcactttc

SEQ ID NO: 1460 - DNA, 30 bp, Artificial Sequence
  chemically synthesized
cagtatggtagctcaccccggatcaccttc

SEQ ID NO: 1461 - DNA, 27 bp, Artificial Sequence
  chemically synthesized
cagtataataactggccccggacgttc

SEQ ID NO: 1462 - DNA, 33 bp, Artificial Sequence
  chemically synthesized
cagtataataactggcctcctatgtacactttt

SEQ ID NO: 1463 - DNA, 30 bp, Artificial Sequence
  chemically synthesized
cagtatggtagctcacctccgtacactttt

SEQ ID NO: 1464 - DNA, 27 bp, Artificial Sequence
  chemically synthesized
caaactcttcaaactccgctcactttc

SEQ ID NO: 1465 - DNA, 30 bp, Artificial Sequence
  chemically synthesized
caaggaacacactggccccccctcactgtc

SEQ ID NO: 1466 - DNA, 27 bp, Artificial Sequence
  chemically synthesized
cagtatggaagctcaccgggaacgttc

SEQ ID NO: 1467 - DNA, 30 bp, Artificial Sequence
  chemically synthesized
cagtatcataactggcctccgtacactttt

SEQ ID NO: 1468 - DNA, 30 bp, Artificial Sequence
  chemically synthesized
caatattatagtagtactccgtacactttt

SEQ ID NO: 1469 - DNA, 30 bp, Artificial Sequence
  chemically synthesized
cagtatggtagctcaccaatattcactttc

SEQ ID NO: 1470 - DNA, 27 bp, Artificial Sequence
  chemically synthesized
cagtatggtagttcacctaacaccttc

SEQ ID NO: 1471 - DNA, 27 bp, Artificial Sequence
  chemically synthesized
cagcaccatgatttccctttcactttc

SEQ ID NO: 1472 - DNA, 27 bp, Artificial Sequence
  chemically synthesized
cagcgttacaactggcctatcaccttc

SEQ ID NO: 1473 - DNA, 27 bp, Artificial Sequence
  chemically synthesized
caatatgcaagtactccatacactttt

SEQ ID NO: 1474 - DNA, 27 bp, Artificial Sequence
  chemically synthesized
cagcgtagcaactggcctcggacgttc

SEQ ID NO: 1475 - DNA, 27 bp, Artificial Sequence
  chemically synthesized
cagtatggtagatcaccgtacacttct

SEQ ID NO: 1476 - DNA, 27 bp, Artificial Sequence
  chemically synthesized
cagtttgataatgtcccagtcactttc

SEQ ID NO: 1477 - DNA, 27 bp, Artificial Sequence
  chemically synthesized
cagcttaatagttaccctcagacgttc

SEQ ID NO: 1478 - DNA, 27 bp, Artificial Sequence
  chemically synthesized
caagctctacaaactccgtacactttt

SEQ ID NO: 1479 - DNA, 30 bp, Artificial Sequence
  chemically synthesized
cagtataataactggcctccgatcaccttc

SEQ ID NO: 1480 - DNA, 24 bp, Artificial Sequence
  chemically synthesized
caagctctacaaactcggacattc

SEQ ID NO: 1481 - protein, 454 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGSLSRSGWYAGLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1482 - protein, 454 aa, Artificial Sequence
  chemically synthesized
QITLKESGGGVVQPGRSLRLSCAASGFTFSSYSMNWVRQAPGKGLQWVAIISDDGSKSYYADSVQGRFTISRDNSRNTVFLQMNSLRAEDTAMYYCARDRGTKWNQLNDVFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1483 - protein, 453 aa, Artificial Sequence
  chemically synthesized
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGRGYSSSRLYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1484 - protein, 450 aa, Artificial Sequence
  chemically synthesized
QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1485 - protein, 449 aa, Artificial Sequence
  chemically synthesized
EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1486 - protein, 446 aa, Artificial Sequence
  chemically synthesized
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEYFYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1487 - protein, 453 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVNPGSYTREVSNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1488 - protein, 451 aa, Artificial Sequence
  chemically synthesized
QVQLQQSGPELVKPSQTLTLTCGISGDSVSSNSVTWNWVRQSPSRGLEWLGRTYYRSQWYYNYAVSVKSRITISPDTSKNQFSLQLNSVTPEDTAVYYCATRGHNYGVDYWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1489 - protein, 450 aa, Artificial Sequence
  chemically synthesized
QVQLVQSGGGLVKPGGSLRLSCAASGFTFSNAWMSWVRQAPGKGLEWVCRIKSKTDGETTDYAAPVKGRFTISRDDSKNTLYLQMNSLKTEDTAVYHCTTGVGWSPFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1490 - protein, 457 aa, Artificial Sequence
  chemically synthesized
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRDDKIAAAGFTYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1491 - protein, 448 aa, Artificial Sequence
  chemically synthesized
QVQLVQSGAEVKKPGASVKVSCKASGYTFAAYYLHWVRQAPGQGLEWMGRISPGNGVTSYAQKFQGRVTMTGDTSINTVYMQLNNLISGDTAVYYCAREAADDPFDHWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1492 - protein, 445 aa, Artificial Sequence
  chemically synthesized
EVQLVQSGGGVVQPGRSLTLSCAASGFTFSSHLMHWVRQAPGKGLEWVAVISYDGTSKYYGDSVKGRFTISRDNSKNTLYLQMNSLRAEDTAIYYCAKADYKYDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1493 - protein, 455 aa, Artificial Sequence
  chemically synthesized
EVQLVQSGGGLVKPGGSLRLSCTASGFTFGDYAMSWVRQAPGKGLEWVGFIRSKAYGGTTEYAASVKGRFTISRDDSKSIAYLQMNSLKTEDTAVYYCTTHRRPIYDILTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1494 - protein, 451 aa, Artificial Sequence
  chemically synthesized
QLQLQESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTREDTMVRGVIPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1495 - protein, 458 aa, Artificial Sequence
  chemically synthesized
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARDRRYYDSSGYYPAYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1496 - protein, 452 aa, Artificial Sequence
  chemically synthesized
EVQLVQSGGGLVKPGGSLRLSCAASGFTFSSYSMNWVRQAPGKGLEWVSYISSSGSYTNYADSVKGRFTISRDNAKNSLYLQINSLRAEDTAIYYCARDGGYDSSGFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1497 - protein, 459 aa, Artificial Sequence
  chemically synthesized
QVQLQQSGPGLVKPSQTLSLTCAISGDSVSNNRAAWNWIRQSPSRGLEWLGRTYYRSKWYNEYAVSVKSRITINPDTSKNQFSLQLNSMTPEDSAVYYCAILPSSGYLQDHHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1498 - protein, 452 aa, Artificial Sequence
  chemically synthesized
EVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARAAVGDGYSYGRLDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1499 - protein, 457 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPSYYYDSSGYFTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1500 - protein, 452 aa, Artificial Sequence
  chemically synthesized
EVQLVQSGAEVKKPGASVKVSCKASGYTFTSYGISWVRQAPGQGLEWMGWIIPIFGIANYAQKFQGRVTITADKSTSTAYMELSSLRSEDTAVYYCARELYNYGSKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1501 - protein, 453 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGTWDTAMVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1502 - protein, 454 aa, Artificial Sequence
  chemically synthesized
EVQLVQSGAEVKKPGESLKISCKGSGYSFTSYWIAWVRQMPGKGLEWMGVIYPGDSDTRYSPSFQGQVTISADKSINTAYLQWSSLKASDTAMYYCARPHYDILTGSRAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1503 - protein, 450 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1504 - protein, 453 aa, Artificial Sequence
  chemically synthesized
EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1505 - protein, 447 aa, Artificial Sequence
  chemically synthesized
QITLKESGGGLVQPGGSLRLSCTVSGFTFSNNWMTWVRQTPGKGLEWVANIKQDGTEKHYVDSVKGRFTISRDNAENSLYLQMNSLRGEDTAVYYCARNSQRSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1506 - protein, 451 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGDPRGGILNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1507 - protein, 455 aa, Artificial Sequence
  chemically synthesized
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSPWGELSLYQGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1508 - protein, 451 aa, Artificial Sequence
  chemically synthesized
QITLKESGGGLVQPGRSLRLSCAASGFTFDDYAMHWVRQAPGKGLEWVSAISGSGGSTYYADSVKGRFTISRDNSKNTLYLQMNSLRAEDTAVYYCAKDNDFWSGKVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1509 - protein, 451 aa, Artificial Sequence
  chemically synthesized
EVQLVQSGGGLVQPGGSLRLSCAASGFTFSSYSMNWVRQAPGKGLEWVSYISSTSSTIYYADSVKGRFTISRDNSKNMLFLQMNSLRAEDTAVYYCAKEGGSGWRHYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1510 - protein, 453 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARDYCSSTSCQNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1511 - protein, 449 aa, Artificial Sequence
  chemically synthesized
QVQLVQSGGGLVQPGGSLRLSCAASGFTFSNYVMSWVRQAPGKGLEWVSAISGIGDTTYYADSVKGRFTISRDNAKNTLYLQMNSLRAEDTAVYYCARGRVAGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1512 - protein, 453 aa, Artificial Sequence
  chemically synthesized
QLQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQGAAAGTLGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1513 - protein, 453 aa, Artificial Sequence
  chemically synthesized
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCTRGIYDSSGSSNPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1514 - protein, 454 aa, Artificial Sequence
  chemically synthesized
EVQLVQSGAEVKKPGASVKISCEASGYTFTDYAIHWVRQAPGQRLEWMGWINAGDGGTKSSREFQGRVTITRDTSATTAYMEVSSLRSEDTAVYYCARGYCSGGSCPGTDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1515 - protein, 452 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGVGGRDGYNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1516 - protein, 449 aa, Artificial Sequence
  chemically synthesized
EVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARAPLAADGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1517 - protein, 452 aa, Artificial Sequence
  chemically synthesized
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARARGLQYLIWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1518 - protein, 453 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCASPGMVRGVITAPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1519 - protein, 450 aa, Artificial Sequence
  chemically synthesized
EVQLVQSGGGLVKPGGSLRLSCAASGFTFSSYAISWVRQAPGQGLEWMGGIIPMYGTANYAQKFQGRVTITADESTSTAYMELSSLRSEDTALYYCAREAKWGMYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1520 - protein, 454 aa, Artificial Sequence
  chemically synthesized
EVQLVESGGGVVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1521 - protein, 448 aa, Artificial Sequence
  chemically synthesized
QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1522 - protein, 456 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1523 - protein, 453 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGTMVRGFGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1524 - protein, 456 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAMIGPLPRLVGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1525 - protein, 454 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPAPSWVKTRNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1526 - protein, 449 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREASSGWNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1527 - protein, 454 aa, Artificial Sequence
  chemically synthesized
QVQLQESGPGLVKPSQTLSLTCAISGDSVSSNNAAWNWIRQSPSRGLEWLGRTFYRSKWYNDYAVSVKSRLTVNPDTSKNQFSLRLNSVSPEDTAVYYCARGGRYTKGGYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1528 - protein, 453 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRLDSSGRGGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1529 - protein, 457 aa, Artificial Sequence
  chemically synthesized
EVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKELVGTSSPYYYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1530 - protein, 448 aa, Artificial Sequence
  chemically synthesized
QLQLQESGGGLVQPGGSLRLSCAASGFTVSSNYMSWVRQAPGKGLEWVSVIYSGGSTYYADSVKGRFTISRDNSKNTLYLQMNSLRAEDTAVYYCARDYYYGSGSSPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1531 - protein, 455 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPYCSSTSCYPEWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1532 - protein, 457 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKLRGIDYYDSSGYQRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1533 - protein, 449 aa, Artificial Sequence
  chemically synthesized
QVQLQESGPGLVKPSETLSLTCTVSGGSISSYYWSWIRQPPGKGLEWIGYIYYTGSTNYNPSLKSRVTISVDTSKNQFSLKLSSVTTADTAVYYCARGGRGDGAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1534 - protein, 453 aa, Artificial Sequence
  chemically synthesized
QVQLVQSGGGVVQPGRSLRLSCAASGFTFSSSAMHWVRQAPGKGLEWVAMIWHDESKKYYADSVKGRFTISRDNSKNTLYLQMNSLRAEDTAVYYCARPPDGGNSGRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1535 - protein, 459 aa, Artificial Sequence
  chemically synthesized
QMQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDKNVRKHDYGDHPYGGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1536 - protein, 448 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVAGATSLWYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1537 - protein, 451 aa, Artificial Sequence
  chemically synthesized
QVQLQQSGPGLVKPSQSLSLTCAISGDSVSSNSAAWNWIRQSPSRGLEWLGRTYYRSKWYNDYAVSVKSRITIKPDTSKNQFSLQLNSVTPEDTAVYYCTRLANSDGVDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1538 - protein, 450 aa, Artificial Sequence
  chemically synthesized
QVQLQQSGPGLVKPSQTLSLTCAISGDSVSSDSAVWTWIRQSPSRGLEWLGRTYYKSKWYNDYAASVKSRITINPDTSKNQFSLHLNSVTPEDTAVYYCARGVTRTFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1539 - protein, 449 aa, Artificial Sequence
  chemically synthesized
QLQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAEGNGPFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1540 - protein, 450 aa, Artificial Sequence
  chemically synthesized
QITLKESGGGVVQPGRSLRLSCVASGFTFSTYPMHWVRQAPGKGLEWVAVISYDGRNEYYADSVKGRFTISRDNSKNTLYLQMNSLRAEDTAVYYCATRDTPLVGVSIYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1541 - protein, 451 aa, Artificial Sequence
  chemically synthesized
QMQLVQSGGGLVKAGGSLRLSCSASGFTFSSYAMHWVRQAPGKGLEYVSAISSNGGSTYYADSVKGRFTISRDNSKNTLYLQMSSLRAEDTAVYYCVNRAGYGDYRHFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1542 - protein, 449 aa, Artificial Sequence
  chemically synthesized
EVQLVQSGGGVVQPGGSLRLSCAASGFTFSSYGMHWVRQAPGKGLEWVAFISYDGSNKYYADSVKGRFTISRDNSKNTLYLQMNSLRAEDTAVYYCATTGDRFQEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1543 - protein, 452 aa, Artificial Sequence
  chemically synthesized
QMQLVQSGGVLLQPGRSLRLSCTASGFTFAAYNINWFRQGPGGGLEWVGFIRANADSGTTEYAASVKGRFFISRDDSRSTAYLQMTSLKTEDTAVYYCARDDRGRGDDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1544 - protein, 451 aa, Artificial Sequence
  chemically synthesized
QVQLVQSGGGLVQPGGSLRLSCAASGFTFSSYGMTWVRQAPGKGLEWVSTISGNGVGTYYPDSVKDRFTISRDSSKNTVYLQMNSLRAEDTAVYYCVKHGRAGINWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1545 - protein, 451 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGGLWAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1546 - protein, 447 aa, Artificial Sequence
  chemically synthesized
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKIGSCPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1547 - protein, 451 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPDSSSQCFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1548 - protein, 449 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1549 - protein, 452 aa, Artificial Sequence
  chemically synthesized
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDVNPELLGAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1550 - protein, 453 aa, Artificial Sequence
  chemically synthesized
QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1551 - protein, 453 aa, Artificial Sequence
  chemically synthesized
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVKAPRGVVPAAMRGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1552 - protein, 454 aa, Artificial Sequence
  chemically synthesized
QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1553 - protein, 459 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRSLPYRGLAPRSFGGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1554 - protein, 451 aa, Artificial Sequence
  chemically synthesized
QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1555 - protein, 454 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGMYYYGSGSSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1556 - protein, 451 aa, Artificial Sequence
  chemically synthesized
QVQLVQSGGGLVQPGGSLRLSCAASGFTFSSYAMSWVRQAPGKGLEWVSGISGSGGSTYYADSVKGRFTISRDNSKNMLFLQMNSPRAEDTAVYYCAKKIAAAGKQPVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1557 - protein, 461 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRKVYDYVWGSYRLPGSVSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1558 - protein, 449 aa, Artificial Sequence
  chemically synthesized
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPGRAARPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1559 - protein, 455 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGAVAGTKPKYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1560 - protein, 453 aa, Artificial Sequence
  chemically synthesized
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARATYYYDSSGYRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1561 - protein, 446 aa, Artificial Sequence
  chemically synthesized
EVQLVQSGGGLVEPGGSLRLSCAASRFTFSDAWMSWVRQAPGKGLEWVGRIKSKISGGTTDYAAPVQGRFTISRDDSKNTLYLQMDSLKTEDTAVYYCANRNLGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1562 - protein, 457 aa, Artificial Sequence
  chemically synthesized
EVQLVQSGAEVKKPGASVKVSCKASGYTFTSYAMHWVRQAPGQRLEWMGWINAGNGNTKYSQKFQGRVTMTTDTSTSTAYMELRSLRSDDTAVYYCARARYYDSSGYIAPSGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1563 - protein, 452 aa, Artificial Sequence
  chemically synthesized
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGPAVDGAEYFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1564 - protein, 453 aa, Artificial Sequence
  chemically synthesized
QLQLQESGPGLVKPSQTLSLTCAISGDSVSSNSAAWNWIRQSPSRGLEWLGRTYYRSKWYNDYAVSLKSRITINPDTSKNQFSLQLNSVTPEDTAVYYCASLASGSPPPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1565 - protein, 449 aa, Artificial Sequence
  chemically synthesized
QVTLKESGGGVVQPGRSLRLSCAASGFTFSTYGMHWVRQAPGKGLEWVALISYDGSKKYYANSVKGRFTISRDNSKNTLYLQMKSLRAEDTAMYYCAKGPIVGATMDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1566 - protein, 448 aa, Artificial Sequence
  chemically synthesized
EVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARWYGDYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1567 - protein, 458 aa, Artificial Sequence
  chemically synthesized
EVQLVQSGAEVKKPGASVKVSCKASGYTFTSYAMHWVRQAPGQRLAWMGWINAGNGNTKYSEKFEGRVTITRDTSASTAYMELSSLRSEDTAVYYCARVAKYYYESGGYRASNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1568 - protein, 457 aa, Artificial Sequence
  chemically synthesized
QVQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAPPPTVGWYAPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1569 - protein, 450 aa, Artificial Sequence
  chemically synthesized
QLQLQESGGGLVQPGGSLRLSCSASGISFRDYWMHWIRQTPGKGLVWVSRINPDGSSTSYADSVKGRFTISRDNSKNTLYLQMNSLRAEDTAVYYCAKVTGRRVGAHDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1570 - protein, 451 aa, Artificial Sequence
  chemically synthesized
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAFAQPGAETLNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1571 - protein, 450 aa, Artificial Sequence
  chemically synthesized
QVQLQQSGPGLVKPSQTLSLTCAISGDSVSSKSAAWNWIRQSPSRGLEWLGRTYYRSKWNNDYALSVKSRITINPDTSKNQFSLQLKSVTPEDTALYYCVRQVAGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1572 - protein, 453 aa, Artificial Sequence
  chemically synthesized
QVQLVQSGGGLVQPGRSLRLSCTASGFTFGDYAMSWFRQAPGKGLEWVSAISGSGGSTYYADSVKGRFTISRDNSKNTLYLQMNSLRAEDTAVYYCAKGSVYSGSYYMLIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1573 - protein, 455 aa, Artificial Sequence
  chemically synthesized
QVQLQQSGPGLVRPSQTLSLTCVISGDSVSSGSAAWNWIRQSPSRGLEWLGRTYYRAKWYNEYAGSVKSRITISPDTSKNQFSLQLNSVTPEDTAVYFCTRQDKDNTRYSGLGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1574 - protein, 453 aa, Artificial Sequence
  chemically synthesized
EVQLVETGGGLVQPGGSLRLSCAASEFTLRNYGVSWVRQAPGKGLEWVSGMSGSGYSTYYADSVKGRFTISRDSSKNTLFLQMDSLRAEDTAIYYCARGPRMWSSGIDAFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1575 - protein, 446 aa, Artificial Sequence
  chemically synthesized
QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1576 - protein, 452 aa, Artificial Sequence
  chemically synthesized
QVQLQQSGPGLLKPSQTLSLTCAISGDSVSSNTATWNWIRQSPSRGLEWLGRTYYRSKWYKDNALSVKSRITINPDTSKNQFSLQLNSVTPEDTAVYYCAGGRAGIAAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1577 - protein, 450 aa, Artificial Sequence
  chemically synthesized
QVQLVQSGGGLIQPGGSLRLSCAASGFTVSSNYMSWVRQAPGKGLEWVSLIYSDGRTNYADSVKGRFTISRDNSKNTLYLQMNSLRAEDTAVYYCAKGALQGEWRRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1578 - protein, 456 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCTRTNQGYGGNSGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1579 - protein, 450 aa, Artificial Sequence
  chemically synthesized
QVQLQQSGPGLVKPSQTLSLTCAISGDSVSGNSAAWNWIRQSPSRGLEWLGRTYYRSKWYNDYAVSVKSRITINPDTSKNQFSLQLNSVTPEDTAVYYCARIVGGAVDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1580 - protein, 454 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVRVGATTVYDSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1581 - protein, 459 aa, Artificial Sequence
  chemically synthesized
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGGSSPYYDSSGLLPWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1582 - protein, 449 aa, Artificial Sequence
  chemically synthesized
QVQLQESGGGLVQPGGSLRLSCAASGFTFSSYAMHWVRQAPGKGLEYVSAISSNGGSTYYANSVKGRFTISRDNSKNTLYLQMGSLRAEDMAVYYCARAKFWTYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1583 - protein, 452 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGGSGSYYKRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1584 - protein, 457 aa, Artificial Sequence
  chemically synthesized
EVQLVQSGAEVRKPGASVKVSCKASGYTFTSYAISWVRQAPGQGLEWMGWISAYDGNTNYAQKLQGRVTMTTDTSTSTAYMEVRSLRSDDTAVYYCARDGTVRRVVGATTPGNFDYRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1585 - protein, 454 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDLNRGYCSGGSCFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1586 - protein, 450 aa, Artificial Sequence
  chemically synthesized
QVQLQESGGGLVQPGGSLRLSCAASGFTFSSYAMSWVRQAPGKGLEWVSYISSSGTTIYYADSVKGRFTVSRDNAKNSLYLQMNSLRAEDTAVYYCARDYSSSGECFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1587 - protein, 450 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDQAAMVGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1588 - protein, 453 aa, Artificial Sequence
  chemically synthesized
QVTLKESGGGVVQPGRSLRLSCAASGFIFSNYAIHWVRQAPGKGLEWVAVISYDGSNKYYADSVKGRFTISRDNSKNTLYLQMNSLRAEDTAVYYCARTFAGYSSKLGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1589 - protein, 215 aa, Artificial Sequence
  chemically synthesized
ETTLTQSPATLSVSLGERATLSCRASQSIGSNLVWYQLKPGQGPRLVIYSATSRATGIPARFSGSGSGTEFILSISNLQSEDLAVYYCQQYGSSPPTTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1590 - protein, 215 aa, Artificial Sequence
  chemically synthesized
EIVMTQSPATLSLSPGERATLSCRASQSVSSSYLAWYQQKPGRAPRLLIYGASNRATGIPDRFSGSGSGTDFTLIISRLEPEDFALYYCQQYGSSPGTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1591 - protein, 214 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1592 - protein, 220 aa, Artificial Sequence
  chemically synthesized
EIVLTQSPDSLAVSLGERATITCKSSRNILYSGNNKNFLAWYQHKPGQPPKLLIYWASTRESGVPDRFSGSGSGTDFTLTINSLEAEDAATYYCHQSSSLPHTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1593 - protein, 214 aa, Artificial Sequence
  chemically synthesized
ETTLTQSPGTLSLSPGQRATLSCRASESVSKSYLLWYQQKPGQAPRLLIYGASTRASGIPNRFSGSGSGTDFTLTISRLEPEDSAVYYCQHYGSSRTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1594 - protein, 217 aa, Artificial Sequence
  chemically synthesized
ETTLTQSPGTLSLSPGERATLSCRASQSISSTYLAWYQQKPGQAPRLLIYGASTRATGIPDRFSGSGSGTDFTLSISRLEPEDFAVYYCQQYGNSPPGATFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1595 - protein, 220 aa, Artificial Sequence
  chemically synthesized
DIQLTQSPSSLSASVGERVTITCRSSQALRNVVGLGDDLAWYQHTPGSAPKILIYSTSTLQSGVSSRFSGGKSGRDFTLTIDRLQPGDSATYYCLQHHDFPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1596 - protein, 219 aa, Artificial Sequence
  chemically synthesized
DVVMTQSPLSLPVTPGEPASISCRSSQSLLNSNGYNYLEWYLQKPGQSPQLLIYLGSNRASGVPDRFSGSGSGTDFTLKISRVEADDAGVYYCMQSLQTPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1597 - protein, 216 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1598 - protein, 216 aa, Artificial Sequence
  chemically synthesized
DVVMTQSPATLSVSPGERATLSCRASQSVSSNLAWYQQKPGQAPRLLIYGASTRATGIPARFSGSGSGTEFTLTISSLQSEDFAVYYCQQYNNWPPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1599 - protein, 214 aa, Artificial Sequence
  chemically synthesized
DVVMTQSPATLSVSPGERVTLSCRASQSVRDNVGWYKQKPGQPPRLVIYGASTRATGIPARISGSGSGTEFTLTISSLQSEDFAVYYCQQFNNWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1600 - protein, 214 aa, Artificial Sequence
  chemically synthesized
DIQMTQSPSSLSASVGDRVTITCRASQSISSYLNWYQQKPGKAPNLLIYAASSLHTGVPSRFSGSGSGTDFTLTISSLQPEDFATYYCQQSYSIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1601 - protein, 215 aa, Artificial Sequence
  chemically synthesized
DVVMTQSPATLSVTPGERATLSCRASQSVNSNVAWYQQKPGQAPRLLIYDVSTRATDIPARFSGSGSGTDFTLTISRLDPEDFAVYYCQQCASSPPVTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1602 - protein, 216 aa, Artificial Sequence
  chemically synthesized
EIVMTQSPATLSLSPGERATLSCGASQSVSSSYLAWYQQKPGLAPRLLIYDASSRATGIPDRFSGSGSGTDFTLTISRLEPEDFAVYYCQQYGSSPRVTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1603 - protein, 215 aa, Artificial Sequence
  chemically synthesized
DVVMTQSPGTLSLSPGERATLSCRASQSVSSSALAWFQQKPGQAPRLLIYDSSSRATGIPDSFSGSGSGTEFTLTISSLQPEDFATYYCQQFNTYPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1604 - protein, 218 aa, Artificial Sequence
  chemically synthesized
DIQMTQSPLSLPVTPGEPASISCRSSQSLLHSNGYNYLDWFLQKPGQSPRLLIYMGSSRASGVPERFSGSGSGTDFTLKISRVEAEDVGVYYCMQTLHTVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1605 - protein, 214 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSLLFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1606 - protein, 215 aa, Artificial Sequence
  chemically synthesized
DIQLTQSPSFLSASVGDRVTITCRASQGISSSLAWYQQKPGKAPKLLIYAASTLQSGVPSRFSGSGSGTDFTFTISSLQPEDIATYYCQQYDNLPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1607 - protein, 219 aa, Artificial Sequence
  chemically synthesized
DVVMTQSPLSLPVTPGEPASISCRSSQSLLHSNGYNYLDWYLQKPGQSPQLLIYLGSNRASGVPDRFSGSGSGTDFTVKISRVEAEDVGVYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1608 - protein, 219 aa, Artificial Sequence
  chemically synthesized
EIVLTQSPLSLPVTLGQPASISCRSCQSLVYSDGNTYLNCFQQRPGQSPRRLIYKVSNRDSGVPDRFSGSGSGTDFTLEISRVEAEDVGIYFCMQGLQTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1609 - protein, 216 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSPALTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1610 - protein, 219 aa, Artificial Sequence
  chemically synthesized
EIVMTQSPLSLPVTPGEPASISCRSSQSLLHSNGYNYLDWYLQKPGQSPQLLIYLGSTRASGVPDRFSGSGSGTDFTLKISRAEAEDVGVYYCMQALHTPWTFGLGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1611 - protein, 215 aa, Artificial Sequence
  chemically synthesized
DIQMTQSPATLSVSPGERATLFCRASEGLTTNLAWYQHKPGQAPRLLIYAASTRATGVPARFSGSGSGTDFTLTISSLQSEDSAVYYCQQYNHWPLYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1612 - protein, 214 aa, Artificial Sequence
  chemically synthesized
DIQLTQSPSTLSLSPGERATLSCRASQSVSSYLAWYQQKSGQAPRLLIYDASNRATGIPARFSGSGSGTDFTLTISSLEPEDFAVYYCQQGSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1613 - protein, 219 aa, Artificial Sequence
  chemically synthesized
DIVMTHTPLSSPVTLGQPASISCRSSQSLEHTDGNTYLSWLHQRPGQPPRLLIYKVSTRFSGVPDRFSGSGAGTDFTLKISRVEAEDVGVYYCVQATHYPRTFGHGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1614 - protein, 216 aa, Artificial Sequence
  chemically synthesized
EIVLTQSPGTLSLSPGERATLSCRASQSISGSYLAWYQQKRGQAPRLLIYDASSRAEGIPDRFIGSGSGTDFTLTISRLEPEDFAMYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1615 - protein, 219 aa, Artificial Sequence
  chemically synthesized
EIVLTQSPDSLPVTPGEPASISCRSSQSLLHSNGNNYLDWYLQKPGQSPQLLIYLGSNRASGVPDRFSGSGSGTDFTLKLSRVEAEDVGVYYCMQGLQIPITFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1616 - protein, 214 aa, Artificial Sequence
  chemically synthesized
DIQMTQSPSSVSASVGDRVTITCRASQNIRHWLVWYQQKLGQAPKLLIYAASNLQSGVPSRFSGSGSGTEFTLTINSLQAEDFATYYCLQHNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1617 - protein, 214 aa, Artificial Sequence
  chemically synthesized
EIVLTQSPDFQSVTPKQKVTITCRASQSIGGSLHWYQQKPGQSPKLIIKYASQSFSGVPSRFSGSGSGTDFTLTIDSLEAEDAATYYCHQSISLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1618 - protein, 214 aa, Artificial Sequence
  chemically synthesized
ETTLTQSPGTLSLSPGEGATLSCRASQSVTSNYLAWYQQKPGQAPRLLIYGASYRATGIPDRFSGSGSGTDFTLTISRLEPEDFAVYYCQQYASSVTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1619 - protein, 214 aa, Artificial Sequence
  chemically synthesized
DVVMTQSPATLSVSPGERATLSCRASQSISSNLAWYQQKPGQAPRLLIYGASTRATGIPARFSGSGSGTEFTLTISSLQSEDFAVYYCQQYNNWPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1620 - protein, 220 aa, Artificial Sequence
  chemically synthesized
DIQLTQSPDSLAVSLGERATINCKSSQSVLYSSNNKNYLAWYQQKPGQPPKLLIYWASARESGVPDRFSGSGSGTDFTLTINSLQAEDVAVYYCQQFYSPPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1621 - protein, 216 aa, Artificial Sequence
  chemically synthesized
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPGTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1622 - protein, 215 aa, Artificial Sequence
  chemically synthesized
EIVLTQSPGTLSLSPGERATLSCRASQSLSTNLAWYQQKPGQAPRLLIYGASTRATGIPARFSGSGSGTEFTLTITSLQSEDFAVYYCQQYHNWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1623 - protein, 213 aa, Artificial Sequence
  chemically synthesized
DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1624 - protein, 215 aa, Artificial Sequence
  chemically synthesized
ETTLTQSPGTLSLSPGEGATLSCRASHSVGANYIAWYQQKPGQAPRLLIHTASKRATGVPERFSGSGSGTDFTLSISRLEPEDFAVYHCQQYAAAPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1625 - protein, 214 aa, Artificial Sequence
  chemically synthesized
EIVMTQSPSSLSASVGDRVIITCRASQGIANYLAWYQQKPGKGPKLLIYASSTLQSGVPSRFSGSGSGTDFTLTISGLQPEDVATYYCQKYNSVPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1626 - protein, 220 aa, Artificial Sequence
  chemically synthesized
DVVMTQSPVSLAVSLGERATINCKSSQSVLYRTNNKNYLAWYQQKPGQPPKLLIYWASTRESGVPDRFSGSGSGTDFTLTISSLQPEDVAVYYCQQYYNLPRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1627 - protein, 220 aa, Artificial Sequence
  chemically synthesized
DIVMTHTPDSLAVSLGERATINCKSNRSVLYSPNNQNYLGWYQQKPGQPPKLLIYWASTRDSGAPDRFSGSGSGTDFTLTINSLQAEDVAVYYCQQYASTPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1628 - protein, 215 aa, Artificial Sequence
  chemically synthesized
DVVMTQSPATLSLSPGERATLSCRASESVNSNFLAWYQQKPGQAPRLLIYAASTRATGIPARFSGSGSGTEFTLIITSLQSEDFAVYYCQQYNNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1629 - protein, 214 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWSLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1630 - protein, 216 aa, Artificial Sequence
  chemically synthesized
ETTLTQSPGTLSLSPGERATLSCRASQSVSSSYLAWYQQKPGQAPRLLIYGASTRATGIPDRFSGSGSGTDFTLTIGRLEPEDFAVYYCQHYGPSRRITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1631 - protein, 213 aa, Artificial Sequence
  chemically synthesized
ETTLTQSPDTLSVSPGGRATLSCRASQSIGSNLAWYQQKPGQSPRLLIYDASTRATGIPARFSGSGSGTEFTLTISSLESEDFVLYYCQQHGEWPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1632 - protein, 215 aa, Artificial Sequence
  chemically synthesized
DVVMTQSPATLSLSPGERATLSCRASQSVGNSLAWYQQKPGQAPRLLIYDASNRATGIPARFSGSGSGTDFTLTITSLEPEDFAIYYCQQRGTWPPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1633 - protein, 214 aa, Artificial Sequence
  chemically synthesized
DVVMTQSPSSLSASVGDTVTITCRASQSITNWLAWYQQKPGKAPKRLIYGASSLQSGVPSRFSGSGSGTEFTLTISSLQPEDFATYYCQQYTNYPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1634 - protein, 213 aa, Artificial Sequence
  chemically synthesized
DIQMTQSPSTLSASVGDRVTITCRARQSISNRLAWYQQKPGRAPNVLIYKASTLANGVPSRFSGSGSGTEFTLTISSLQPDDFATYYCQQYQSYWTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1635 - protein, 214 aa, Artificial Sequence
  chemically synthesized
DIQLTQSPATLSLSPGERATLSCKASQSVSSYLAWYQQKLGQAPRLLIYDASNRATGIPARFSASGSGTDFTLTISSLQPEDVATYYCQKYNSPPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1636 - protein, 215 aa, Artificial Sequence
  chemically synthesized
ETTLTQSPGTLSLSPGERVSLSCRASQNVYSNFLAWYQQRPGQAPSLLIYGASSRAAGVPDRFSGSGSGTDFALTISRVEPEDFAVYYCQQYGTSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1637 - protein, 219 aa, Artificial Sequence
  chemically synthesized
EIVLTQSPRSSPVTLGQPASISCRSSQSLEHGDGNTYLSWLQQRPGQPPRLLIYKVSNRLSGVPDRFSGSGAGTDFTLKISRVEAEDVGVYYCMQGIYWPRTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1638 - protein, 216 aa, Artificial Sequence
  chemically synthesized
ETTLTQSPVTLSLSPGDRATLSCRASQSVSSTSLAWYQHKPGQAPRLLIYGASRRATGIPDRFSGSGSGTDFTLTINRLEPEDFAVYYCQHYGSSPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1639 - protein, 215 aa, Artificial Sequence
  chemically synthesized
ETTLTQSPATLSVSPGERATLSCRASQSVGSKLAWYQQKPGQAPRLLIYGASTRATGVPVRFSGSGSGTEFTLTISSLQSEDFAVYYCQQYNNWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1640 - protein, 219 aa, Artificial Sequence
  chemically synthesized
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1641 - protein, 221 aa, Artificial Sequence
  chemically synthesized
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1642 - protein, 219 aa, Artificial Sequence
  chemically synthesized
DIVMTHTPLSLSVTPGQPASISCKSSQSLLGGDGKTYLYWYLQKPGQPPQLLLYEVSNRFSGVPDRFSGSGAATDFTLKISRVEAEDVGVYYCMQSTQFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1643 - protein, 216 aa, Artificial Sequence
  chemically synthesized
ETTLTQSPGTLSLSAGERATLSCRASQSVSSSYLAWYQQKPGQAPRLLIYAASYRATGIPDRFSGRGSGTEFTLTISSLQSEDFAVYYCQQYNNWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1644 - protein, 214 aa, Artificial Sequence
  chemically synthesized
DVVMTQSPATLSVSPGERATLSCRASQSVSSNLAWYQQKPGQAPRLLIYDASTRATGIPARFSGSGSGTEFTLTISSLQSEDFAVYYCQHYNNWPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1645 - protein, 214 aa, Artificial Sequence
  chemically synthesized
ETTLTQSPGTLSLSPGERATLSCRASQSVSSNSLAWYQQKPGQAPRLLIYGASSRASGIPDRFNGSGSGTDFTLTINRLEPEDFAVYYCQQYGNSQTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1646 - protein, 214 aa, Artificial Sequence
  chemically synthesized
DVVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1647 - protein, 219 aa, Artificial Sequence
  chemically synthesized
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1648 - protein, 214 aa, Artificial Sequence
  chemically synthesized
DIQMTQSPSTLSASVGDRVTITCRASQSISRWLAWYQQKPGKAPKLLIYKASTIKSGVPSRFSASGSGTEFTLTISSLQPEDFATYYCQHYKSDSRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1649 - protein, 213 aa, Artificial Sequence
  chemically synthesized
DVVMTQSPSSLAASVGDRITITCRPSQDIGTYLNWYQQKAGEAPKLLIYAASNLHSGVSSRFRGVGSGTQFTLTISSLQPEDFATYYCHQSYGPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1650 - protein, 215 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1651 - protein, 215 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSGYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1652 - protein, 212 aa, Artificial Sequence
  chemically synthesized
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1653 - protein, 214 aa, Artificial Sequence
  chemically synthesized
EIVLTQSPSTLSASVGDRVTITCRASQSISSCLAWYQQKPGKAPKLLIYAASTLQSGVPSRFSGSGSGTEFTLTISTLQPEDFATYYCQQLNSYPQTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1654 - protein, 219 aa, Artificial Sequence
  chemically synthesized
DIVMTHTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1655 - protein, 215 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYNNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1656 - protein, 220 aa, Artificial Sequence
  chemically synthesized
DIQLTQSPDSLAVSLGERATINCTSSQSVLYSSNNKNYIAWYQQKPGQPPKLLIYWASTRESGVPDRFSGSGSGTDFTLTISSLQAEDVAVYYCQQYYYIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1657 - protein, 218 aa, Artificial Sequence
  chemically synthesized
DVVMTQSPLSLPVTPGEPASISCRSSQSLLHSNGYNYLDWYLQKPGQSPQLLIYLGSNRAPGVPDRFSGSGSGTDFTLKISRVEAEDVGVYYCMQALQTRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1658 - protein, 215 aa, Artificial Sequence
  chemically synthesized
ETTLTQSPGTLSLSPGERATLSCRASQSLTSSYLAWYQQKPGQAPRLLIYRASSRATGIPDRFSGSGSGTDFTLTISRLEPEDFAVYYCQQYGSSPNTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1659 - protein, 220 aa, Artificial Sequence
  chemically synthesized
EIVLTQSPLSLPVTLGQPASISCRSSQSLVHSNGHTYLSWFQQRPGQSPRRLIYEVSNRDSGVPDRFSGSGSGTDFTLRISRVEAEDVGVYYCLQGTHWPPLTVGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1660 - protein, 214 aa, Artificial Sequence
  chemically synthesized
DVVMTQSPATLSLSPGERATLSCRASQSVGSDLAWYQQKPGQAPRLLIYRASTRAAGIPARFSGSGSGTDFTLTISRLEPEDFAVFYCQQYGRSPYTSGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1661 - protein, 220 aa, Artificial Sequence
  chemically synthesized
DIVMTHTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1662 - protein, 219 aa, Artificial Sequence
  chemically synthesized
EIVMTQSPLSLSVTPGEPASISCRSSQSLLHSSGYNYLDWYLQKPGQSPQLLIYLGSTRASGVPDRFSGSGSGTDFTLKISRVEAEDVGVYYCMQGLQIPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1663 - protein, 219 aa, Artificial Sequence
  chemically synthesized
DIVMTHTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1664 - protein, 213 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPRFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1665 - protein, 214 aa, Artificial Sequence
  chemically synthesized
DVVMTQSPSTLSASVGDRVTITCRASQTINSWLAWYQQKPGKAPKLLISRASRLESGVPSRFSGSASGTEYILTINSLQPDDFAMYFCHQYNSYSPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1666 - protein, 215 aa, Artificial Sequence
  chemically synthesized
ETTLTQSPGTLSLSPGERATLSCRASQSVSSSYLAWYQQKPGQAPRLLIYGASSRATGIPARFSGSGSGTDFTLTISSLEPEDFAVYYCQQRYNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1667 - protein, 214 aa, Artificial Sequence
  chemically synthesized
EIVLTQSPATLSLSPGETATLSCRASQTIGPKSFGWYQQRPGQAPRLLIYDSNRATGIPARFSGSGSGTDFTLTISSLEPEDFAVYYCQQRSRWPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1668 - protein, 219 aa, Artificial Sequence
  chemically synthesized
DVVMTQSPLSLPVTLGQPASISCRSSQSLVYSDGNTYLYWFQQRAGQSPRRLIYKVSKRDSGVPDRFSGSGSGTDFTLKISRVEAEDVGIYYCVQGRHWPYTLGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1669 - protein, 215 aa, Artificial Sequence
  chemically synthesized
EIVLTQSPGTLSLSPGERATLSCRASQSVSSSYLAWYQQKPGQAPRLLIYDASNRATGIPARFSGSGSGTEFTLTISSLQPDDFATYYCQQYNSYSRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1670 - protein, 214 aa, Artificial Sequence
  chemically synthesized
DVVMTQSPSTLSASVGDRVTITCRASQSITTWLAWSQQQPGKAPKLLIYKASSLTSGVPSRFSGSGSGTEFTLTISSLQPDDFASYYCHHYNGASRMFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1671 - protein, 213 aa, Artificial Sequence
  chemically synthesized
ETTLTQSPATLSLSPGERATLSCRASQSVSSYLAWYQQKPGQAPRLLIYDASNRATGIPARFSGSGSGTDFTLTISSLEPEDFAVYYCQQRSNWPFFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1672 - protein, 214 aa, Artificial Sequence
  chemically synthesized
ETTLTQSPATLTLSPGERVTLSCRASQSIGTYVAWYQQKPGQAPRFLIYDSSNRATGIPARFSGSGSGTDFTLTISSLEPEDFAFYYCQQRAEWPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1673 - protein, 216 aa, Artificial Sequence
  chemically synthesized
DVVMTQSPGTLSLSPGERATLSCRASQSVNSGYLAWYQQKPGQPPRLLISGVSTRATGIPDRFSGSGSGTDFTLTISRLEPEDFAVYYCQEYGNSAMYNFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1674 - protein, 215 aa, Artificial Sequence
  chemically synthesized
ETTLTQSPATLSVSPGERATLSCRASQSVSSNLAWYQQKPGQAPRLLIYGASTRATGIPARFSGSGSGTEFTLTISSLQSEDFAVYYCQQYNNWPPFTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1675 - protein, 215 aa, Artificial Sequence
  chemically synthesized
DVVMTQSPGTLSLSPGERATLSCRASQSVSSSYLGWYQQKSGQAPRLLIYGASSRATDIPDRFSGSGSGTDFTLTISKLEAEDSAVYYCQQYGISPLAFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1676 - protein, 215 aa, Artificial Sequence
  chemically synthesized
ETTLTQSPATLSVSPGERATLSCRASQSISNNLAWYQQKPGQAPRLLIYGTSTRATGIPARFSGSGSGTEFTLTISSLQSEDFAVYYCQQYNFWPSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1677 - protein, 214 aa, Artificial Sequence
  chemically synthesized
ETTLTQSPGTLSLSPGERATLSCRASQSVSSSSLAWYQQKPGQAPRLLIYGASSRATGIPDRFSGSGSGTDFTLTISRLEPEDFAVYYCQQYGSSQTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1678 - protein, 219 aa, Artificial Sequence
  chemically synthesized
DVVMTQSPLSLPVSLGQPASISCRSNQSLVYSDGGTYLNWFQQRAGQSPRRLVYKVSNRDSGVPDRFSGSGSGTDFTLRISRVEAEDVGVYYCMQGTHWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1679 - protein, 214 aa, Artificial Sequence
  chemically synthesized
DIQLTQSPSSLSASVGDRVTVTCRASQSISSYLNWYQQKPGKAPQLLIYDASNLETGVPSRFSGSGSGTDFTFTISSLQPEDFATYYCQQFDNVPVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1680 - protein, 219 aa, Artificial Sequence
  chemically synthesized
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1681 - protein, 215 aa, Artificial Sequence
  chemically synthesized
DVVMTQSPATLSVSPGERATLSCRASQSVSSNLAWYQQKPGQAPRLLIYGASSRATGIPDRFSGSGSGTDFTLTINRLEPEDFAVYYCQQYGSSSMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1682 - protein, 214 aa, Artificial Sequence
  chemically synthesized
DVVMTQSPSSLSASVGDSVAITCRASQSISNYLNWYQQRPGKAPKLLIFAASSLQSGVPSRFSGSGSGTDFTLTISSLQPEDFATYSCQQSYITPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1683 - protein, 214 aa, Artificial Sequence
  chemically synthesized
DVVMTQSPGTLSLSPGERATLSCRASQSVSTLLAWYQQKPGQAPRLLIYDASNRATGIPGRFSASGSGTDFSLTISSLETEDSAVYYCQHRYVWPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1684 - protein, 214 aa, Artificial Sequence
  chemically synthesized
DIQMTQSPSSLSASVGDRVTITCRASQGIRNDLGWYQQKPGKAPKRLIYGASSLQSGVPSRFSGSGSGTEFTLTIRSLQPEDFATYYCLQHNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1685 - protein, 214 aa, Artificial Sequence
  chemically synthesized
DVVMTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1686 - protein, 219 aa, Artificial Sequence
  chemically synthesized
DVVMTQSPLSLPVTLGQAASISCRSSHSLTTTDGRTYVAWFQQRPGQSPRRLLYEVSKRDSGAPDRFSGSGSGTDFTLKISRVEADDVGIYHCMQGTHGPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1687 - protein, 215 aa, Artificial Sequence
  chemically synthesized
ETTLTQSPATLSVSPGERATLSCRASQSVTSNLAWYQQKPGQAPRLLIYGASNRATGIPARFSVSGSGTDFTLTISRLEPEDFAVYYCQQYGSPPPTTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1688 - protein, 215 aa, Artificial Sequence
  chemically synthesized
DVVMTQSPGTLSLSPGERATLSCRASQSVSSSYLAWYQQKPGQAPRLLIYGASSRATGIPDRFSGSGSGTDFTLTISRLEPEDFAVYYCQQYGSSRRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1689 - protein, 215 aa, Artificial Sequence
  chemically synthesized
ETTLTQSPGTLSLSPGERATLSCRASQSVFNNYLAWYQQRPGQAPRLLIYGASSRATGIPDRFSGGGSGTDFTLTISRLEPEDFAVYCCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1690 - protein, 215 aa, Artificial Sequence
  chemically synthesized
EIVLTQSPATLSLSPGERATLSCRASQSVSSYLAWYQQKPGQAPRLLIYDASNRATGIPARFSGSGSGTDFTLTISRLEPEDFAVYYCQQYGSSLRYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1691 - protein, 219 aa, Artificial Sequence
  chemically synthesized
EIVLTQSPDSLAVSLGERATINCKSSQSVLYDSNSKNYLSWYQQKPGQPPKLLISWASTRGSGVPDRFSGSGSGTDFTLTISSLQAEDVAVYYCQQFYGIPHFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1692 - protein, 215 aa, Artificial Sequence
  chemically synthesized
DVVMTQSPATLSLSPGERATLSCRASQSVGTNLAWYQQKPGQAPRLLIYDASNRATGIPARFSGSGSGTEFTLTISSLQSEDFAVYYCQQYNNWPPITFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1693 - protein, 219 aa, Artificial Sequence
  chemically synthesized
DVVMTQSPLSLPVTLGQPASISCRSSQSLVYSDGNTYLSWLQQRPGQPPRLLIYKISNRFSGVPDRFSGSGAGTDFTLKISRVEAEDVGVYYCMQGTQFPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1694 - protein, 216 aa, Artificial Sequence
  chemically synthesized
EIVLTQSPGTLSLSPGERATLSCRASQSVISRYLAWYQQKPGQAPRLLIHGASTRATGIPDRFSGSGSGTDFTLTISRLEPEDFAVYYCQQYGSSPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1695 - protein, 214 aa, Artificial Sequence
  chemically synthesized
DIQLTQSPSTLAASVGDRVTITCRASQSISSWLAWYQQKPGKAPKVLIYKASSLESGVPSRFSGSGSGTEFTLTISSLQPDDFATYYCQQYNSYSGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1696 - protein, 214 aa, Artificial Sequence
  chemically synthesized
DVVMTQSPAILSVSPGERATLSCRASQSVSSSLAWYQQKPGQPPRLLIYGASTRATAIPARFSGSGSGTEFTLTISSLQSEDFAVYYCQRYDNWPPLFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1697 - DNA, 1362 bp, Artificial Sequence
  chemically synthesized
gaagtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggctccttgtcccgaagtggctggtacgccggactctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1698 - DNA, 1362 bp, Artificial Sequence
  chemically synthesized
cagatcaccttgaaggagtctgggggaggcgtggtccagcctgggaggtccctgagactctcctgtgcagcctctggattcaccttcagtagttatagcatgaactgggtccgccaggctccaggcaaggggctgcagtgggtggcaattatatcagatgatggaagtaagagttactacgcagactccgtgcagggccgattcaccatctccagagacaattcgaggaacacagtatttctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1699 - DNA, 1359 bp, Artificial Sequence
  chemically synthesized
gaagtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggccgagggtatagcagcagtcggctctactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1700 - DNA, 1350 bp, Artificial Sequence
  chemically synthesized
caggtcaccttgaaggagtctgggggaggcttggtccggcctggagggtccctgagactctcctgtgaagcctctggattcaccttcagtgacccctacatggactgggtccgccaggctccaggcaaggggctggagtgggttggccgaattacaaataagcgtaccggttacgccacaacatatgccgcgtctgtgaaggacagattcaccatctcaagagatgattcaaggaagtcagtatatctgcaaatgaacagcctgaagaccgaggacacggccgtatattattgtgcaacagatgtcagtgggtccttcgcggcctacgggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1701 - DNA, 1347 bp, Artificial Sequence
  chemically synthesized
gaggtccagctggtacagtctgggggaggcgtggtccagcctgggaggtccctgagactctcctgtgcagcgtctggattcaccttcagtagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgggagagggcggagcagtggctggtactgtctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1702 - DNA, 1338 bp, Artificial Sequence
  chemically synthesized
caggtccagctggtgcagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacgagtatttctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1703 - DNA, 1359 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagtaaatccggggagttatacgagggaggtgagcaactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1704 - DNA, 1353 bp, Artificial Sequence
  chemically synthesized
caggtacagctgcagcagtcaggtccagaattggtgaagccctcgcagaccctcacactcacctgtggcatctccggggacagtgtctctagcaacagtgttacttggaactgggtcaggcagtccccatcgagaggccttgagtggctgggaaggacttactaccggtcccagtggtattataattatgcggtgtctgtgaaaagtcgaataaccatcagcccagacacatccaagaaccagttctccctgcagttgaattctgtgactcccgaggacacggctgtctattactgtgcaaccaggggacataactacggtgtagattactggggcccggggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1705 - DNA, 1350 bp, Artificial Sequence
  chemically synthesized
caggtgcagctggtgcagtctgggggaggcttggtaaagcctggggggtcccttagactctcctgtgcagcctctggattcactttcagtaacgcctggatgagctgggtccgccaggctccagggaaggggctggagtgggtttgccgtattaaaagcaaaactgatggtgagacaacagactacgctgcacccgtgaaaggcagattcaccatctcaagagatgattcaaaaaacacgctgtatctgcaaatgaacagcctgaaaactgaggacacagccgtgtatcactgtaccacaggggtgggatggtcgcccttccaatactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1706 - DNA, 1371 bp, Artificial Sequence
  chemically synthesized
gaggtccagctggtacagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacgacaaaatagcagcagctggattcacatactggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1707 - DNA, 1344 bp, Artificial Sequence
  chemically synthesized
caggtgcagctggtgcagtctggggctgaggtgaagaagcctggggcctcagtgaaggtctcctgcaaggcttctggatacaccttcgccgcctattatttacactgggtgcgacaggcccctggacaaggccttgagtggatggggcggatcagccctggtaacggtgtcacaagttatgcacagaaatttcagggcagagtcaccatgaccggggacacgtccattaacacagtctacatgcaactgaacaatttgatttctggcgacacggccgtatattactgtgcgagagaggctgccgacgacccgtttgaccattggggccagggagccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1708 - DNA, 1335 bp, Artificial Sequence
  chemically synthesized
gaagtgcagctggtgcagtctgggggaggcgtggtccagcctgggaggtccctgacactctcctgtgcagcctctggattcaccttcagttcccatcttatgcactgggtccgccaggctccaggcaaggggctggagtgggtggcagttatatcatatgatggaactagtaaatattacggagactccgtgaagggccgcttcaccatctccagagacaattccaagaacacgttgtatctgcaaatgaacagcctgcgagctgaagacacggctatatattactgtgcgaaagcagattataaatatgactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1709 - DNA, 1365 bp, Artificial Sequence
  chemically synthesized
gaggtgcagctggtgcagtctgggggaggcttggtcaagcctggagggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactactcatagacgcccaatttacgatattttgactggttttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1710 - DNA, 1353 bp, Artificial Sequence
  chemically synthesized
cagctgcagctgcaggagtccgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggatactatggttcggggagttattccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1711 - DNA, 1374 bp, Artificial Sequence
  chemically synthesized
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggctgtgtattactgtgcgagagatcggcgttactatgatagtagtggttattatcccgcctactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1712 - DNA, 1356 bp, Artificial Sequence
  chemically synthesized
gaagtgcagctggtgcagtctgggggaggcctggtcaagcctggggggtccctgagactctcctgtgcagcctctggattcaccttcagtagctatagcatgaactgggtccgccaggctccagggaaggggctggagtgggtttcatacattagtagtagtggtagttacacaaactacgcagactctgtgaagggccgattcaccatctccagagacaacgccaagaactcactgtatctgcaaataaacagcctgagagccgaggacacggccatttattactgtgcgagagacgggggctatgatagtagtggttttcactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1713 - DNA, 1377 bp, Artificial Sequence
  chemically synthesized
caggtacagctgcagcagtcaggtccaggactggtgaagccctcgcagaccctctcactcacctgtgccatctccggggacagtgtctctaacaacagggctgcttggaactggatcaggcagtcgccatcgagaggccttgagtggctgggaaggacatactacaggtccaagtggtataatgaatatgcagtctctgtgaaaagtcgaataaccatcaacccagacacatccaagaaccagttctccctgcagctgaactctatgactcccgaggactcggctgtgtattactgtgcaattttgcctagtagtggttatctacaggaccaccactactacggtatggacgtctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1714 - DNA, 1356 bp, Artificial Sequence
  chemically synthesized
gaggtgcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacacggccgtgtattactgtgcgagagccgcggtgggggatggatacagctatggtcggctcgattggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1715 - DNA, 1371 bp, Artificial Sequence
  chemically synthesized
gaggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccctcgtattactatgatagtagtggttactttacctggtacttcgatctctggggccgtggcaccctggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1716 - DNA, 1356 bp, Artificial Sequence
  chemically synthesized
gaggtccagctggtacagtctggagctgaggtgaagaagcctggggcctcagtgaaggtctcctgcaaggcttctggttacacctttaccagctatggtatcagctgggtgcgacaggcccctggacaagggcttgagtggatgggatggatcatccctatctttggtatagcaaactacgcacagaagttccagggcagagtcacgattaccgcggacaaatccacgagcacagcctacatggagctgagcagcctgagatctgaggacacggccgtgtattactgtgcgagagaactatacaactatggttcaaaggactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1717 - DNA, 1359 bp, Artificial Sequence
  chemically synthesized
gaagtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcggtacttgggatacagctatggttacgggctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1718 - DNA, 1362 bp, Artificial Sequence
  chemically synthesized
gaagtgcagctggtgcagtctggagcagaggtgaaaaagcccggggagtctctgaagatctcctgtaagggttctggatacagctttaccagctactggatcgcctgggtgcgccagatgcccgggaaaggcctggagtggatgggggtcatctatcctggtgactctgataccagatacagcccgtccttccaaggccaggtcaccatctcagccgacaagtccatcaataccgcctacctgcagtggagcagcctgaaggcctcggacaccgccatgtattactgtgcgagaccccattacgatattttgactggttcccgggcgccctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1719 - DNA, 1350 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccgagtggaatccaaggatgggtactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1720 - DNA, 1359 bp, Artificial Sequence
  chemically synthesized
gaggtgcagctggtggagtctgggggaggcgtggtccagcctgggaggtccctgagactctcctgtgcagcctctggattcactttcactgatgcctggatgaactgggtccgccaggctccagggaaggggctggagtggattggccgtgttaaaaacaaagctgatggtgagacaacggactacgctgcacccgtcaaaggcagaatcaccatctcaagagatgatgcaaagaacactctgtatgtgcaaatgaacagcctgaaaaccgaggacacagccgtgtattattgtaccgctgacctgcgactttctacgtgggatgcttatgatttctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1721 - DNA, 1341 bp, Artificial Sequence
  chemically synthesized
cagatcaccttgaaggagtctgggggaggcttggtccagcctggggggtccctaagactctcttgtacagtctcaggattcacctttagtaacaattggatgacctgggtccgccagactccagggaaggggctggagtgggtggccaacataaagcaagatggaactgagaaacactatgtggactctgtgaagggccgattcaccatctccagagacaacgccgagaactcactgtatctgcagatgaacagcctgagaggtgaggacacggccgtgtattattgtgcgagaaacagtcaacgttcgtttgactactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1722 - DNA, 1353 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttaggggatccccggggtggtattttgaactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1723 - DNA, 1365 bp, Artificial Sequence
  chemically synthesized
gaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcccggtcgagcccctggggggagttatcgttataccagggggcttttgatatctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1724 - DNA, 1353 bp, Artificial Sequence
  chemically synthesized
cagatcaccttgaaggagtctgggggaggcttggtacagcctggcaggtccctgagactctcctgtgcagcctctggattcacctttgatgattatgccatgcactgggtccggcaagctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataacgatttttggagtgggaaagtctttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1725 - DNA, 1353 bp, Artificial Sequence
  chemically synthesized
gaagtgcagctggtgcagtctgggggaggcttggtacagcctggggggtccctgagactctcctgtgcagcctctggattcaccttcagtagttatagcatgaactgggtccgccaggctccagggaaggggctggagtgggtttcatacatcagtagtactagtagtaccatatactacgcagactccgtgaagggccgattcaccatctccagagacaattccaagaatatgctgtttctacaaatgaacagcctgagagctgaggacacggctgtgtattactgtgcgaaagaagggggcagtggctggcgccactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1726 - DNA, 1359 bp, Artificial Sequence
  chemically synthesized
caggtcaccttgaaggagtctgggggaggcgtggtccagcctgggaggtccctgagactgtcctgtgcagcctctggattcaccttcagcagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagattattgtagtagtaccagctgccagaactggttcgacccctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1727 - DNA, 1347 bp, Artificial Sequence
  chemically synthesized
caggtccagctggtgcagtctgggggaggcttggtacagcctggggggtccctgagactctcctgtgcagcctctggattcacctttagcaactatgtcatgagctgggtccgccaggctccagggaaggggctggagtgggtctcagctattagtggtattggtgatactacatactacgcggactccgtgaagggccgattcaccatctccagagacaacgccaagaacacgctgtatctgcaaatgaacagtctgagagccgaggacacggctgtgtattactgtgcaagagggcgcgtggcgggggatgcttttgatatctggggccaagggacaatggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1728 - DNA, 1359 bp, Artificial Sequence
  chemically synthesized
cagctgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcaaggggcagcagctggtaccctggggtactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1729 - DNA, 1359 bp, Artificial Sequence
  chemically synthesized
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtacgagaggaatctatgatagtagtggttcttccaatccctttgactcctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1730 - DNA, 1362 bp, Artificial Sequence
  chemically synthesized
gaggtgcagctggtgcagtctggggctgaggtgaagaagcctggggcctcagtgaagatttcctgcgaggcttctggatacaccttcactgattatgctatacattgggtgcgccaggcccccggacaaagacttgagtggatgggatggatcaacgctggcgatggtggcacaaaaagttcacgggagttccagggcagagtcaccattaccagggacacatccgcgaccacagcctacatggaggtgagcagtctgagatctgaagacacggctgtctattactgtgcgagaggatattgtagtggtggtagctgcccaggaacggattttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1731 - DNA, 1356 bp, Artificial Sequence
  chemically synthesized
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatggtgtaggagggagagatggctacaattttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1732 - DNA, 1347 bp, Artificial Sequence
  chemically synthesized
gaagtgcagctggtgcagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagcccccctagcagcagatggctactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1733 - DNA, 1356 bp, Artificial Sequence
  chemically synthesized
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagcccgggggctacagtacctaatctggtacttcgatctctggggccgtggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1734 - DNA, 1359 bp, Artificial Sequence
  chemically synthesized
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagcccgggtatggttcggggagttattactgccccgcttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1735 - DNA, 1350 bp, Artificial Sequence
  chemically synthesized
gaggtccagctggtacagtctgggggaggcctggtcaagcctggggggtccctgagactctcctgtgcagcctctggattcaccttcagcagctatgctatcagctgggtgcgacaggcccctggacaagggcttgagtggatgggagggatcatccctatgtatggtacagcaaactacgcacagaagttccagggcagagtcacgattaccgcggacgaatccacgagcacagcctacatggaactgagcagcctgagatctgaggacacggccctctattactgtgcgagagaagctaagtggggaatgtactactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1736 - DNA, 1362 bp, Artificial Sequence
  chemically synthesized
gaggtgcagctggtggagtccgggggaggcgtggtccagcctgggaggtccctgagactctcctgtgcagcctctggattcaccttcagtagctatgctatacactgggtccgccaggctccaggcaaggggctggagtgggtggcaattatatcagatgatggaagtaagagttactacgcagactccgtgcagggccgattcaccatctccagagacaattcgaggaacacagtatatctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1737 - DNA, 1344 bp, Artificial Sequence
  chemically synthesized
cagatgcagctggtgcaatctggggctgaggtgaagaagcctggggcctcagtgaaggtctcctgcacggcttctggatacaccttcaccagttctgatatcaactgggtgcgacaggccactggacaagggcttgagtggatgggatggatgaaccctaacagtggtaacaccggctatgcagagaagttccagggcagggtcaccatgaccagcgactcctccataagcaccgcctacatggagttgagaagcctgaccactgaggacacggccgtatattactgtgcgagaggtgggggtgcgagctatactgactcctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1738 - DNA, 1368 bp, Artificial Sequence
  chemically synthesized
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtaccgctaaggggggctacgtcggatacagctatggaccttttgggggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1739 - DNA, 1359 bp, Artificial Sequence
  chemically synthesized
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggggggactatggttcggggtttcggatttaactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1740 - DNA, 1368 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccggcgggctatgatagggccgcttccgcgacttgtcgggtacttcgatctctggggccgtggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1741 - DNA, 1362 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccgccccgccccatcctgggttaaaacccgtaactggttcgacccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1742 - DNA, 1347 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggctagcagtggctggaactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1743 - DNA, 1362 bp, Artificial Sequence
  chemically synthesized
caggtgcagctgcaggagtccggtccaggactggtgaagccctcgcagaccctctcactcacctgtgccatctccggggacagtgtctctagcaacaatgctgcttggaactggatcaggcagtccccatcgagaggccttgagtggctgggaaggacattctacaggtccaagtggtataatgactatgcagtttctgtgaaaagtcgactaaccgtcaacccagacacatccaagaaccagttctccctgcggttgaactctgtgagtcccgaggacacggctgtgtattactgtgcaagagggggaagatataccaagggagggtactttgacgactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1744 - DNA, 1359 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagattggatagcagtggccgtggtggttactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1745 - DNA, 1371 bp, Artificial Sequence
  chemically synthesized
gaggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagagttggtgggtaccagctctccttattactactactactacggtatggacgtctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1746 - DNA, 1344 bp, Artificial Sequence
  chemically synthesized
cagctgcagctgcaggagtcggggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagactattactatggttcggggagttctccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1747 - DNA, 1365 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccggccatattgtagtagtaccagctgctacccagagtggttcgacccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1748 - DNA, 1371 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaattaaggggtatagattactatgatagtagtggttaccaacgggggtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1749 - DNA, 1347 bp, Artificial Sequence
  chemically synthesized
caggtgcagctgcaggagtccggcccaggactggtgaagccttcggagaccctgtccctcacctgcactgtctctggtggctccatcagtagttactactggagctggatccggcagcccccagggaagggactggagtggattggctatatctattacactgggagcaccaactacaacccctccctcaagagccgagtcaccatatcagtagacacgtccaagaaccagttctccctgaagctgagctctgtgaccactgcggacacggccgtgtattactgtgcgagaggtgggaggggggatggggccgcttttgacatctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1750 - DNA, 1359 bp, Artificial Sequence
  chemically synthesized
caggtgcagctggtgcaatctgggggaggcgtggtccagcctgggaggtccctgagactctcctgtgcagcgtctggattcaccttcagcagctctgccatgcactgggtccgccaggctccaggcaagggactggagtgggtggcaatgatttggcatgatgagagtaagaaatactatgcagactccgtgaagggccgattcactatctccagagacaattccaagaacacgctgtatctgcaaatgaacagcctgagagctgaggacacggctgtgtattactgtgcgagaccccccgacggtggtaactccggtcgctggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1751 - DNA, 1377 bp, Artificial Sequence
  chemically synthesized
cagatgcagctggtgcaatctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacaagaacgtccgaaaacatgactacggtgaccacccctacggggggtactttgactactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1752 - DNA, 1344 bp, Artificial Sequence
  chemically synthesized
gaggtccagctggtacagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagtggcgggagctacttccctatggtactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1753 - DNA, 1353 bp, Artificial Sequence
  chemically synthesized
caggtacagctgcagcagtcaggtccaggactggtgaagccctcgcagagcctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaagagtcgaataaccatcaaaccagacacatccaagaaccagttctccctgcagctgaactctgtgactcccgaggacacggctgtgtattactgtacaaggctagctaattccgacggtgtggacgtctggggccaagggacaatggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1754 - DNA, 1350 bp, Artificial Sequence
  chemically synthesized
caggtacagctgcagcagtcaggtccaggactggtgaagccctcgcagaccctctcactcacctgtgccatctccggggacagtgtctctagcgacagtgctgtttggacctggatcaggcagtccccatcgagaggccttgagtggctgggaaggacatactacaagtcgaagtggtataatgattatgcagcatctgtgaaaagtcgaataaccatcaacccagacacatccaagaaccagttctccctgcacctgaactctgtgactcccgaggacacggctgtgtattactgtgcaagaggtgtaacccggacctttgactactggggccaggggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1755 - DNA, 1347 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcagaaggcaatgggccgttcgacccctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1756 - DNA, 1350 bp, Artificial Sequence
  chemically synthesized
cagatcaccttgaaggagtctgggggaggcgtggtccagcctgggaggtccctgagactctcctgtgtagcctctggattcaccttcagtacctatcccatgcactgggtccgccaggctccaggcaaggggctggagtgggtggcagttatatcatatgatggacgtaatgaatactacgcagactccgtgaagggccgattcaccatctccagagacaattccaaaaacacgctgtatctgcaaatgaacagtctgcgagctgaagacacggctgtctattattgtgcgactcgggatacacctttggttggggtttcgatatactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1757 - DNA, 1353 bp, Artificial Sequence
  chemically synthesized
cagatgcagctggtgcaatctgggggaggcctggtcaaggctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaatcgggcgggttacggtgactacagacacttccagcactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1758 - DNA, 1347 bp, Artificial Sequence
  chemically synthesized
gaggtgcagctggtgcagtctgggggaggcgtggtccagcctggggggtccctgagactctcctgtgcagcgtctggattcaccttcagtagctatggcatgcactgggtccgccaggctccaggcaaggggctggagtgggtggcatttatatcatatgatggaagtaataaatactacgcagactccgtgaagggccgattcaccatctccagagacaattccaagaacacgctgtatctgcaaatgaacagcctgagagccgaggacacggccgtatattactgtgcgacaacaggggaccgcttccaagagtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1759 - DNA, 1356 bp, Artificial Sequence
  chemically synthesized
cagatgcagctggtgcagtctgggggagtcttgcttcagccagggcggtccctgagactctcctgtacagcttctggattcacctttgctgcttataatatcaactggttccgccagggtcctgggggggggctggagtgggtaggtttcattagagccaacgctgatagtgggacaacagagtacgccgcgtctgtgaaaggcagattcttcatctcaagagatgattccagaagcaccgcctacctgcaaatgactagccttaaaaccgaggacacagccgtttattactgtgccagagatgatcggggtcggggagatgactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1760 - DNA, 1353 bp, Artificial Sequence
  chemically synthesized
caggtgcagctggtgcaatctgggggaggcttggtacagcctggggggtccctgagactctcctgtgcagcctctggattcacctttagcagctatggcatgacgtgggtccgccaggctccagggaaggggctggagtgggtctcaactattagtggtaatggtgttggcacatactacccagactccgtgaaggaccggttcaccatctccagagacagttccaagaacacggtgtatctgcaaatgaacagcctgagagccgaggacacggccgtatattactgtgtgaaacatggtagggccggaataaactggtacttcgatctctggggccgtggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1761 - DNA, 1353 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggggagggctttgggcttttgatatctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1762 - DNA, 1341 bp, Artificial Sequence
  chemically synthesized
gaggtccagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacaagatcggcagctgtccttactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1763 - DNA, 1353 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccggatagcagcagtcaatgttttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1764 - DNA, 1347 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaagcagtggctggtcactgcctgaagactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1765 - DNA, 1356 bp, Artificial Sequence
  chemically synthesized
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacggatgtgaacccggagctactgggggcgggatttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1766 - DNA, 1359 bp, Artificial Sequence
  chemically synthesized
caggtcaccttgaaggagtctgggggaggcttggtccagcctggagggtccctgagactctcctgtgcagcctctggattcaccttcagtgaccagtacatggactgggtccgccaggctccagggaaggggctggagtgggttggccgtgttagaaacaaagctaacagttacaccacagaatacgccgcgtctgtgaaaggcagattcaccatctcaagagatgattcaaagaactcactgtatctgcaaatgaatagtctgaacaccgaggacacggccatgtatttctgtgctagtagtctcaatagtgggggctaccgatgcttccatcactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1767 - DNA, 1359 bp, Artificial Sequence
  chemically synthesized
caggtccagctggtgcagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaaagcgccgaggggtgtagtaccagctgctatgcgggggggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1768 - DNA, 1362 bp, Artificial Sequence
  chemically synthesized
caggtgcagctgcaggagtcggggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattggtgggcaatagtgggagctactatccgtttgggtactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1769 - DNA, 1377 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctcggtgaccgccgcggacacggctgtgtattactgtgcgagaggccggtcccttccctaccgggggttggctcctagatctttcggaggatactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1770 - DNA, 1353 bp, Artificial Sequence
  chemically synthesized
caggtgcagctgcaggagtcggggggaggcttggtacggcctggagggtccctgagactctcctgtggagactctggattcaacttcagtggatatgaaatgaactgggtccgccaggctccagggaaggggctggagtgggtttcatacgtcagtactagtggtagtaccagatactacgcagactctgtgaagggccgatttaccatctccagagacaacgccaagaacaccctgtatttgcaaatgaacagtctgagagtcgaggacacggctgtgtattactgtgcaagaggacggactcactggggcccccaggactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1771 - DNA, 1362 bp, Artificial Sequence
  chemically synthesized
caggtgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggaggaatgtattactatggttcggggagctcgtactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1772 - DNA, 1353 bp, Artificial Sequence
  chemically synthesized
caggtgcagctggtgcaatctgggggaggcttggtacagcctggggggtccctgagactctcctgtgcagcctctggattcacctttagcagctatgccatgagctgggtccgccaggctccagggaaggggctggaatgggtctcaggtattagtggtagtggtggtagcacatactacgcagactccgtgaagggccggttcaccatctccagagacaattccaagaacatgctgtttctgcaaatgaacagcccgagagccgaggacacggccgtatattactgtgcgaagaaaatagcagcagctggtaagcaacctgttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1773 - DNA, 1383 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaggaaggtgtatgattacgtttgggggagttatcgcctccccgggtcggtatcgtactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1774 - DNA, 1347 bp, Artificial Sequence
  chemically synthesized
caggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccggggagagcagctcgtccagactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1775 - DNA, 1365 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggccccggggcagtggctggtactaagccaaagtactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1776 - DNA, 1359 bp, Artificial Sequence
  chemically synthesized
gaggtccagctggtgcagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggccacgtattactatgatagtagtggttataggtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1777 - DNA, 1338 bp, Artificial Sequence
  chemically synthesized
gaggtccagctggtacagtctgggggaggcttggtagaaccgggggggtcccttagactctcctgtgcagcctctcgattcactttcagtgacgcctggatgagctgggtccgccaggctccaggtaaggggctggagtgggttggccgtattaaaagcaaaataagtggtgggacaacagactacgctgcacccgtgcaaggcagattcaccatctcaagagatgattcaaaaaacacgctgtatctgcaaatggacagcctgaaaaccgaggacacagccgtgtattactgtgcgaaccgaaacttaggctactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1778 - DNA, 1371 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccatgaccacagacacatccacgagcacagcctacatggagctgaggagcctgagatctgacgacacggccgtgtattactgtgcgagagctcgttactatgatagtagtggttatattgccccatcgggttactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1779 - DNA, 1356 bp, Artificial Sequence
  chemically synthesized
caggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatggccccgccgttgatggtgctgaatacttccagcactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1780 - DNA, 1359 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgcgaggccttgagtggctgggaaggacttactacaggtccaagtggtataatgattatgcagtatctctgaaaagtcgaataaccatcaacccggacacatccaagaaccagttctccctgcagctgaactctgtgactcccgaggacacggctgtatattactgtgcaagtttggcgagtggttccccccctccgggggactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1781 - DNA, 1347 bp, Artificial Sequence
  chemically synthesized
caggtcaccttgaaggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaaaaaatactatgcaaactccgtgaagggccgattcaccatctccagagacaattccaagaacacgttgtatctgcaaatgaaaagtctgagagctgaggacacggctatgtattactgtgcgaaaggccctatagtgggagcgactatggactactggggccagggagccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1782 - DNA, 1344 bp, Artificial Sequence
  chemically synthesized
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatggtacggtgactacggccttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1783 - DNA, 1374 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgcgtggatgggatggatcaacgctggcaatggtaacacaaaatattcagagaagttcgaaggcagagtcaccatcaccagggacacatccgcgagcacagcctacatggagctgagcagcctgagatctgaagacacggctgtgtattactgtgcgagggtcgccaaatattattacgagagtggtggttatcgggcctccaactggttcgacccctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1784 - DNA, 1371 bp, Artificial Sequence
  chemically synthesized
caggtgcagctgcaggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagcgccccctccgactgttggctggtacgcccccgtctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1785 - DNA, 1350 bp, Artificial Sequence
  chemically synthesized
cagctgcagctgcaggagtccgggggaggcttagttcagccgggggggtccctgagactctcctgctcagcctctggaatcagcttcagagattactggatgcactggatccgccaaactccagggaaggggctggtgtgggtctcacgtattaatcctgatgggagtagcacaagctacgcggactccgtgaagggccgattcaccatctccagagacaattccaagaacacgctgtatctgcaaatgaacagcctgagagctgaggacacggctgtgtattactgtgcgaaagttacgggacggagagtgggagcccatgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1786 - DNA, 1353 bp, Artificial Sequence
  chemically synthesized
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcctttgcccagccgggcgctgagacgttgaacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1787 - DNA, 1350 bp, Artificial Sequence
  chemically synthesized
caggtacagctgcagcagtcaggtccaggactggtgaagccctcgcagaccctctcactcacctgtgccatctccggggacagtgtctctagcaaaagtgctgcttggaactggatcaggcagtccccatcgagaggccttgagtggctgggaaggacatactacaggtccaaatggaataatgattatgcattatctgtgaaaagtcgaataaccatcaacccagacacatccaagaaccagttctccctgcagctgaagtctgtgactcccgaggacacggctctgtattactgtgtaagacaagtcgcgggcggtatggacgtctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1788 - DNA, 1359 bp, Artificial Sequence
  chemically synthesized
caggtgcagctggtgcaatctgggggaggcttggtacagccagggcggtccctgagactctcctgtacagcttctggattcacctttggtgattatgctatgagctggttccgccaggctccagggaaggggctggagtgggtctcagctattagtggtagtggtggtagcacatactatgcagactccgtgaagggccgattcaccatctccagagacaattccaagaacacgctgtatctgcaaatgaacagcctgagagctgaggacacggctgtgtattactgtgcgaaaggatcggtatatagtgggagctactatatgctcattgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1789 - DNA, 1365 bp, Artificial Sequence
  chemically synthesized
caggtacagctgcagcagtcaggtccaggactggtgaggccctcgcagaccctctcactcacctgtgtcatctccggggacagtgtctctagcggcagtgctgcttggaactggatcaggcagtccccatcgagaggccttgagtggctgggaaggacatattatagggccaagtggtataatgaatatgcagggtctgtgaaaagccgaataaccatcagtccggacacatccaagaaccagttctccctgcaactgaactctgtgactcccgaggacacggctgtgtatttctgtacaagacaagacaaagacaacacgagatattccggtttgggcgtctggggccaagggaccacggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1790 - DNA, 1359 bp, Artificial Sequence
  chemically synthesized
gaggtgcagctggtggagaccgggggaggcttagttcagcctggggggtccctgagactctcctgtgcagcctctgaattcacccttaggaactatggcgtgagctgggtccgccaggctccagggaaggggctggagtgggtctcaggtatgagtggtagtggttatagtacatactacgcagactccgtgaagggccggttcaccatctccagagacagttccaagaacacgctgtttctgcaaatggacagcctgagagccgaggacacggccatatattactgtgcgagagggccccgaatgtggagcagtggcattgatgcttttgatatctggggccacgggacaatggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1791 - DNA, 1338 bp, Artificial Sequence
  chemically synthesized
caggtgcagctacagcagtggggcgcaggactgttgaagccttcggagaccctgtccctcacctgcgctgtctatggtgggtccgtcagtggttactactggagctggatccgccagcccccagggaaggggctggagtggatgggggaaatccatcatagtggaagcaccaactacaacccgtccctcaagagtcgagtcaccatatcactagacacgcccaagaaccagttctccctgaagctaagctctgtgaccgccgcggacacggctgtatattactgtgcgagacgggattgggcaggaaaaagggtctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1792 - DNA, 1356 bp, Artificial Sequence
  chemically synthesized
caggtacagctgcagcagtcaggtccaggactattaaagccctcgcagaccctctcactcacctgtgccatctccggggacagtgtctctagcaacactgctacttggaactggatcaggcagtccccatcgagaggccttgagtggctgggaaggacatactacaggtccaagtggtataaggataatgcactgtctgtgaaaagtcgaataaccatcaacccagacacatccaagaaccagttctccctgcagctgaactctgtgactcccgaggacacggctgtgtattactgtgcaggaggtcgggctggtattgccgcttttgatatctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1793 - DNA, 1350 bp, Artificial Sequence
  chemically synthesized
caggtgcagctggtgcaatctggaggaggcttgatccagcctggggggtccctgagactctcctgtgcagcctctgggttcaccgtcagtagcaactacatgagctgggtccgccaggctccagggaaggggctggaatgggtctcacttatttatagtgatggtcgcacaaactatgcagactccgtgaagggccgattcaccatctccagagacaattccaagaacacgctgtatctgcaaatgaacagcctgagagccgaggacacggccgtatattactgtgcgaagggggccctacagggcgaatggcggagatttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1794 - DNA, 1368 bp, Artificial Sequence
  chemically synthesized
caggtgcagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataatgattatgcagtatctgtgaaaagtcgaataaccatcaacccagacacatccaagaaccagttctccctgcagctgaactctgtgactcccgaggacacggctgtgtattactgtacaagaaccaaccagggatacggtggtaactccggggtatttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1795 - DNA, 1350 bp, Artificial Sequence
  chemically synthesized
caggtgcagctacagcagtcaggtccaggactggtgaagccctcgcagaccctctcactcacctgtgccatctccggggacagtgtctctggcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagttgaattctgtgactcccgaggacacggctgtgtattactgtgcgaggatagtgggaggtgccgttgactgctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1796 - DNA, 1362 bp, Artificial Sequence
  chemically synthesized
gaggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagttagagtgggagctactactgtttacgacagctggttcgacccctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1797 - DNA, 1377 bp, Artificial Sequence
  chemically synthesized
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggggggtccagcccatactatgatagtagtggtttactaccctggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1798 - DNA, 1347 bp, Artificial Sequence
  chemically synthesized
caggtgcagctgcaggagtcggggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagctaagttttggacatactactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1799 - DNA, 1356 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcggtggttcggggagttattataagaggttctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1800 - DNA, 1371 bp, Artificial Sequence
  chemically synthesized
gaggtgcagctggtgcagtctggagctgaggtgaggaagcctggggcctcagtgaaggtctcctgcaaggcttctggttacacatttaccagttatgccatcagctgggtgcgacaggcccctggacaagggcttgagtggatggggtggatcagcgcttacgacggtaacacaaactatgcacagaagctccagggcagagtcaccatgaccacagacacatccacgagcacagcctacatggaggtgaggagcctgagatctgacgacacggccgtgtattactgtgcgagagatggtacggtccgaagggtagtgggagctactacccctggaaactttgactacaggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1801 - DNA, 1362 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgaatcgaggatattgtagtggtggtagctgctttggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1802 - DNA, 1350 bp, Artificial Sequence
  chemically synthesized
caggtgcagctgcaggagtctgggggaggcttggtacagccgggggggtccctgagactctcctgtgcagcctctggattcacctttagcagctatgccatgagctgggtccgccaggctccagggaaggggctggagtgggtttcatacattagtagtagtggtactaccatatactacgcagactctgtgaagggccgattcaccgtctccagagacaatgccaagaactcactgtatctgcaaatgaacagcctgagagccgaggacacggccgtgtattactgtgcgagggattatagcagctcgggggagtgctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1803 - DNA, 1350 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcaggcagctatggtaggctactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1804 - DNA, 1359 bp, Artificial Sequence
  chemically synthesized
caggtcaccttgaaggagtctgggggaggcgtggtccagcctgggaggtccctgagactctcctgtgcagcctctggattcatcttcagtaactatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggacttttgcggggtatagcagcaaactggggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacaactctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctatactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 1805 - DNA, 645 bp, Artificial Sequence
  chemically synthesized
gaaacgacactcacgcagtctccagccaccctatctgtgtctctaggagaaagagccaccctttcttgcagggccagtcagagtattggcagcaacttagtctggtaccagctgaaacctggccagggtcccaggctcgtcatatatagtgcaacctctagggccactggaatcccagccaggttcagcggcagtgggtctgggacagagttcattctctccatcagcaacctgcagtctgaagatcttgcagtttattactgtcagcagtatggtagttcacctccgaccaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1806 - DNA, 645 bp, Artificial Sequence
  chemically synthesized
gaaattgtgatgacacagtctccagccaccctgtctttgtctccaggggaaagagccaccctctcctgcagggccagtcagagtgttagcagcagctacttagcctggtaccagcaaaaacctggccgggctcccaggctcctcatctatggcgcatccaacagggccacaggcatcccagacaggttcagtggcagtgggtctgggacagacttcactctcatcatcagcagactggagcctgaagattttgccttgtattactgtcagcagtatggaagctcaccgggaacgttcggccaagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1807 - DNA, 642 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcggacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1808 - DNA, 660 bp, Artificial Sequence
  chemically synthesized
gaaattgtgttgacgcagtctccagactccctggctgtgtctctgggcgagagggccaccatcacctgcaagtccagccggaatattttatacagcggcaacaataaaaacttcttggcttggtatcagcacaaaccaggacagcctcctaagttgctcatttactgggcatctacccgggaatccggggtccctgaccgatttagtggcagcgggtctgggacagatttcaccctcaccatcaatagcctggaagctgaagatgctgcaacgtattactgtcatcagagtagtagtttacctcacactttcggccctgggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1809 - DNA, 642 bp, Artificial Sequence
  chemically synthesized
gaaacgacactcacgcagtctccaggcaccctgtctttgtctccagggcaaagagccaccctctcctgcagggccagtgagagtgttagcaagagctacttactctggtaccagcagaaacctggccaggctcccagactcctcatctatggtgcatccaccagggccagtggcatcccaaacaggttcagtggcagtgggtctgggacagacttcactctcaccatcagcagactggagcctgaagattctgcagtgtattactgtcagcactatggcagctctcgcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1810 - DNA, 651 bp, Artificial Sequence
  chemically synthesized
gaaacgacactcacgcagtctccaggcaccctgtctttgtctccaggggaaagagccaccctctcctgcagggccagtcagagtattagcagcacctacttagcctggtaccagcagaaacctggccaggctcccaggctcctcatctatggtgcatccaccagggccactggcatcccagacaggttcagtggcagtgggtctgggacagacttcactctcagcatcagcagactggagcctgaagattttgcagtgtattactgtcagcagtatggtaactcacctccgggagccaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1811 - DNA, 660 bp, Artificial Sequence
  chemically synthesized
gacatccagttgacccagtctccttcctccctgtctgcatctgtgggagaaagagtcaccatcacttgccggtccagccaggccctgcgaaatgttgtcggccttggcgatgatttagcctggtatcaacacacgccaggcagcgcccccaagatcctgatctactctacatcgactttacaaagtggagtctcatcaagattcagcggcggaaagtctgggagagacttcactctcacgatcgatcgtctgcagcctggagattctgcaacttattactgtctccagcaccatgatttccctttcactttcggccctgggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1812 - DNA, 657 bp, Artificial Sequence
  chemically synthesized
gatgttgtgatgactcagtctccactctccctgcccgtcacccctggagagccggcctccatctcctgcaggtctagtcagagcctcctgaatagtaatggatacaactatttggagtggtacctgcagaagccggggcagtctccacagctcctgatctatttgggttctaatcgggcctccggggtccctgacaggttcagtggcagtggatcaggcacagattttacactgaaaatcagcagagtggaggctgacgatgctggtgtttattactgcatgcagtctctacaaactcctctcactttcggcggtgggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1813 - DNA, 648 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccccggatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1814 - DNA, 648 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcctatgtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1815 - DNA, 642 bp, Artificial Sequence
  chemically synthesized
gatgttgtgatgactcagtctccagccaccctgtctgtgtctccaggggaaagagtcacactctcctgcagggccagtcagagtgttagagacaacgtaggttggtacaagcagaaacctggccaacctcccaggctcgtcatctatggtgcatccaccagggccactggtatcccagccaggatcagtggcagtgggtctgggacagagttcactctcaccatcagcagcctgcagtctgaagattttgcagtttattactgtcagcagtttaataattggccttacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1816 - DNA, 642 bp, Artificial Sequence
  chemically synthesized
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatctatgctgcatccagtttgcacactggggtcccatcaaggttcagtggcagtggatctgggacagatttcactctcaccatcagcagtctgcaacctgaagattttgcaacttactactgtcaacagagttacagtattcctcgaacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1817 - DNA, 645 bp, Artificial Sequence
  chemically synthesized
gatgttgtgatgactcagtctccagccaccctgtctgtgactccaggggaaagggccaccctctcctgcagggccagtcaaagtgttaacagcaacgtagcctggtaccagcagaaacctggccaggctcccaggctcctcatctatgatgtatccaccagggccactgatatcccagccaggttcagtggcagtgggtctgggacagacttcactctcaccatcagcagacttgaccctgaagattttgcagtgtattactgtcagcagtgtgctagctcacctcctgtcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1818 - DNA, 648 bp, Artificial Sequence
  chemically synthesized
gaaattgtgatgacgcagtctccagccaccctgtctttgtctccaggggaaagagccaccctctcctgcggggccagtcagagtgttagcagcagctacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcgggtcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1819 - DNA, 645 bp, Artificial Sequence
  chemically synthesized
gatgttgtgatgactcagtctccaggcaccctgtctttgtctccaggggaaagagccaccctctcctgcagggccagtcagagtgttagcagcagcgccttagcctggttccagcagaaacctggccaggctcccaggctcctcatctatgattcatccagcagggccactggcatcccagacagcttcagcggcagtggatctgggacagaattcacactcacaatcagtagcctgcagcctgaagattttgcaacttattactgtcaacagtttaatacctaccccaacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1820 - DNA, 654 bp, Artificial Sequence
  chemically synthesized
gacatccagatgacccagtctccactctccctgcccgtcacccctggagagccggcctccatctcctgcaggtctagtcagagcctcctgcatagtaatggatacaactatttggattggttcctgcagaagccagggcagtctccacggctcctgatctatatgggttctagtcgggcctccggggtccctgagaggttcagtggcagtggatcaggcacagattttacactgaaaatcagcagagtggaggctgaggatgttggggtctattactgcatgcaaactttacacactgtcactttcggcggcgggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1821 - DNA, 642 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcctcttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1822 - DNA, 645 bp, Artificial Sequence
  chemically synthesized
gacatccagttgacccagtctccatccttcctgtctgcatctgttggagacagagtcaccatcacttgccgggccagtcagggcattagcagttctttggcctggtatcagcaaaagccagggaaagcccctaagctcctgatctatgctgcatccactttgcaaagtggggtcccatcaaggttcagtggaagtggatctgggacagattttactttcaccatcagcagcctgcagcctgaagatattgcaacatattactgtcaacagtatgataatctccctcctctcactttcggcggagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1823 - DNA, 657 bp, Artificial Sequence
  chemically synthesized
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagatttcacagtgaaaatcagcagagtggaggctgaggatgttggggtttattactgcatgcaagctctacaaactccgtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1824 - DNA, 657 bp, Artificial Sequence
  chemically synthesized
gaaattgtgttgacgcagtctccactctccctgcccgtcacccttggacagccggcctccatctcctgcaggtcttgtcaaagcctcgtatacagtgatggcaacacctacttgaattgctttcagcagaggccaggccaatctccaaggcgcctaatttataaggtttctaaccgggactctggggtcccagacagattcagcggcagtgggtcaggcacagattttacactggaaatcagcagagtggaggctgaggatgttgggatttatttctgcatgcaaggtctacaaactccattcactttcggccctgggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1825 - DNA, 648 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctgcgctcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1826 - DNA, 657 bp, Artificial Sequence
  chemically synthesized
gaaattgtgatgacgcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctactcgggcctccggggtccctgacaggttcagtggcagtggatcaggcacagactttacactgaaaatcagcagagcggaggctgaggatgttggggtttattactgcatgcaagctctacacactccgtggacgttcggcctagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1827 - DNA, 645 bp, Artificial Sequence
  chemically synthesized
gacatccagatgacccagtctccagccaccctgtctgtgtctccaggggaaagggccaccctcttttgccgggccagtgaaggtcttaccaccaacttagcctggtaccagcacaaacctggccaggctcccaggctcctcatctatgctgcctccaccagggccactggtgtcccagccaggttcagtggcagtgggtctgggacagacttcactctcaccatcagcagcctgcagtctgaagattccgcagtttattactgtcagcagtataatcactggcctctctacacttttggccaggggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1828 - DNA, 642 bp, Artificial Sequence
  chemically synthesized
gacatccagttgacccagtctccttccaccctgtctttgtctccaggggaaagagccaccctctcctgcagggccagtcagagtgttagcagctacttagcctggtaccaacagaaatctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagggtagcaactggccgctcactttcggcggagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1829 - DNA, 657 bp, Artificial Sequence
  chemically synthesized
gatattgtgatgacccacactccactctcctcacctgtcacccttggacagccggcctccatctcctgcaggtctagtcaaagcctcgaacacactgatggaaacacctacttaagttggcttcaccagaggccaggccagcccccaagactgttaatttataaggtttctacccggttctctggggtcccagacagattcagtggcagtggggcagggacagatttcacactgaaaatcagcagggtggaggctgaggatgtcggcgtttattactgcgtgcaggctacacactatcctcggacgttcggccatgggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1830 - DNA, 648 bp, Artificial Sequence
  chemically synthesized
gaaattgtgctgactcagtctccaggcaccctgtccttgtctccaggggaaagagccaccctctcctgcagggccagtcagagtattagcggcagttacttagcctggtaccagcagaaacgtggccaggctcccaggctcctcatctatgatgcgtccagcagggccgaaggcatcccagacaggttcattggcagtgggtctgggacagacttcactctcaccatcagcagactggagcctgaagactttgctatgtattactgtcagcagtatggtagctcaccaatattcactttcggccctgggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1831 - DNA, 657 bp, Artificial Sequence
  chemically synthesized
gaaattgtgctgactcagtctccagactccctgcccgtcacccctggagagccggcctccatctcctgcaggtctagtcagagcctcctgcatagtaatggaaacaactatttggattggtacctgcagaagccagggcagtctccacagctcctgatctatttgggttctaatcgggcctccggggtccctgacaggttcagtggcagtggatcaggcacagattttacactgaaactcagcagagtggaggctgaggatgttggggtttattactgcatgcaaggtctacaaatccctatcactttcggccctgggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1832 - DNA, 642 bp, Artificial Sequence
  chemically synthesized
gacatccagatgacccagtctccatcttctgtgtctgcatctgtgggagacagagtcaccatcacttgtcgggcgagtcagaacattcgccactggttagtctggtatcagcaaaaattagggcaagcccctaaactcctgatctatgctgcgtccaatttgcaaagtggggtcccgtcaaggttcagcggcagtggatctgggacagaattcactctcacaatcaacagcctgcaggctgaagattttgcaacctattactgtctacagcataacagttacccgtggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1833 - DNA, 642 bp, Artificial Sequence
  chemically synthesized
gaaattgtgttgacgcagtctccagactttcagtctgtgactccaaagcagaaagtcaccatcacctgccgggccagtcagagcattggtggtagcttacactggtaccagcagaaaccaggtcagtctccaaagctcatcatcaagtatgcttcccagtccttctcaggggtcccctcgaggttcagtggcagtggatctgggacagatttcaccctcaccatcgatagcctggaggctgaagatgctgcaacgtactattgtcatcagagtatcagtttaccgctcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1834 - DNA, 642 bp, Artificial Sequence
  chemically synthesized
gaaacgacactcacgcagtctccaggcaccctgtctttgtctccaggggaaggagccaccctctcctgcagggccagtcagagtgttaccagcaactacttagcctggtaccagcagaaacctggccaggctcccaggctcctcatctatggtgcatcctacagggccactggcatccctgacaggttcagcggcagtgggtctgggacagacttcactctcaccatcagcagactggagcctgaagattttgcagtgtattactgtcagcagtatgctagctcagtcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1835 - DNA, 642 bp, Artificial Sequence
  chemically synthesized
gatgttgtgatgactcagtctccagccaccctgtctgtgtctccaggggaaagagccaccctctcctgcagggccagtcagagtattagcagcaacttagcctggtaccagcagaaacctggccaggctcccaggctcctcatctatggtgcctccaccagggccactggtatcccagccaggttcagtggcagtgggtctgggacagagttcactctcaccatcagcagcctgcagtctgaagattttgcagtttattactgtcagcagtataataactggcctagaacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1836 - DNA, 660 bp, Artificial Sequence
  chemically synthesized
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctgcccgggaatccggggtccctgaccgattcagtggcagcgggtctgggacagatttcactctcaccatcaacagcctgcaggctgaagatgtggcagtttattactgtcagcaattttatagtcctcctcggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1837 - DNA, 648 bp, Artificial Sequence
  chemically synthesized
gaaattgtgttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccccgggcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1838 - DNA, 645 bp, Artificial Sequence
  chemically synthesized
gaaattgtgctgactcagtctccaggcaccctgtctttgtctccaggggaaagagccaccctctcctgcagggccagtcagagtttaagtaccaacttagcctggtaccagcagaaacctggccaggctcccaggctcctcatctatggtgcatccaccagggccactggtatcccagccaggttcagtggcagtgggtctggcacagagttcactctcaccatcaccagcctgcagtctgaagattttgcagtttattactgtcagcagtatcataactggcctccgtacacttttggccaggggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1839 - DNA, 639 bp, Artificial Sequence
  chemically synthesized
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1840 - DNA, 645 bp, Artificial Sequence
  chemically synthesized
gaaacgacactcacgcagtctccaggcaccctgtctttgtctccaggggaaggcgccaccctctcctgcagggccagtcacagtgttggcgccaactacatagcctggtaccagcagaaacctggccaggctcccaggctccttatccatactgcatccaaaagggccactggcgtcccagagaggttcagtggcagtgggtctgggacagacttcactctcagtatcagcagactggagcctgaagactttgccgtgtatcactgtcagcagtatgctgccgcaccgattaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1841 - DNA, 642 bp, Artificial Sequence
  chemically synthesized
gaaattgtgatgacacagtctccatcctccctgtctgcatctgtgggggacagagtcatcatcacttgccgggcgagtcagggcattgccaattatttagcctggtatcagcagaaaccagggaaaggtcctaaactcctgatctatgcttcatctactttgcaatcaggggtcccatctcggttcagtggcagtggatctgggacagatttcactctcaccatcagcggcctgcagcctgaagatgttgcaacttattactgtcagaagtataacagtgtccctctcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1842 - DNA, 660 bp, Artificial Sequence
  chemically synthesized
gatgttgtgatgactcagtctccagtctccctggctgtgtctctgggcgagagggccaccatcaactgcaagtccagccagagtgttttatacagaaccaacaataagaactacttggcttggtatcagcagaaaccaggacagcctcctaagttgctcatttactgggcatctacccgggaatccggggtccctgaccgattcagtggcagcgggtctgggacagatttcactctcaccatcagcagcctgcagcctgaggatgtggcagtgtactactgtcagcaatattacaatcttcctcgatcttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1843 - DNA, 660 bp, Artificial Sequence
  chemically synthesized
gatattgtgatgacccacactccagactccctggctgtgtctctgggcgagagggccaccatcaactgcaagtccaaccggagtgttttatacagccccaacaatcagaactacttaggttggtaccagcagaagccaggacagcctcctaagctgctcatttactgggcatctacccgggactccggggcccctgaccgattcagtggcagcgggtctgggacagatttcactctcaccatcaacagcctgcaggctgaagatgtggcagtttattactgtcagcaatatgcaagtactccatacacttttggccaggggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1844 - DNA, 645 bp, Artificial Sequence
  chemically synthesized
gatgttgtgatgactcagtctccagccaccctgtctttgtctccaggggaaagagccaccctctcctgcagggccagtgagagtgttaatagcaacttcttagcctggtaccagcagaaacctggccaggctcccaggctcctcatctatgctgcatccaccagggccactggtatcccagccaggttcagtggcagtgggtctgggacagagttcactctcatcatcaccagcctgcagtctgaagattttgcagtttattactgtcagcagtataataactggccgctcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1845 - DNA, 642 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggtcgctcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1846 - DNA, 648 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccaacagaaacctggccaggctcccaggctcctcatctatggtgcttccaccagggccactggcatcccagacaggttcagtggcagtgggtctgggacggacttcactctcaccatcggcagactggagcctgaagattttgcagtgtattactgtcaacactatggtccctcacgtcggatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1847 - DNA, 639 bp, Artificial Sequence
  chemically synthesized
gaaacgacactcacgcagtctccagacaccctgtctgtgtctccagggggaagagccaccctctcctgtagggccagtcagagcattgggagcaatttagcctggtaccaacagaaacctggccagtctcccaggctcctcatctatgatgcatccaccagggccacgggaatcccagccaggttcagtggcagtgggtctgggacagaattcactctcaccatcagcagcctggagtctgaagattttgtactttattactgtcagcagcatggtgaatggcccaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1848 - DNA, 645 bp, Artificial Sequence
  chemically synthesized
gatgttgtgatgactcagtctccagccaccctgtctttgtctccaggggaaagagccaccctctcctgcagggccagtcagagtgtcggtaactccttagcctggtaccagcagaagcctggccaggctccccggctcctcatctatgatgcatccaacagggccactggcatcccagcccggttcagtggcagtgggtctgggacagacttcactctcaccatcaccagcctagagcctgaagattttgcaatttattactgtcaacaacgtggcacctggcctcccctcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1849 - DNA, 642 bp, Artificial Sequence
  chemically synthesized
gatgttgtgatgactcagtctccatcctccctgtctgcatctgtaggagacacagtcaccatcacttgccgggccagtcagagtataactaactggttggcctggtatcagcagaaaccagggaaagcccccaagcgcctgatctatggtgcgtccagtttgcagagtggggtcccatcaaggttcagcggcagtggatctgggacagaattcactctcacaatcagcagcctgcagcctgaagattttgcaacttattactgtcaacagtatactaattaccctcgtacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1850 - DNA, 639 bp, Artificial Sequence
  chemically synthesized
gacatccagatgacccagtctccttccaccctgtctgcatctgtaggagacagagtcaccatcacttgtcgggccaggcagagcatcagtaaccggttggcctggtatcagcagaaaccagggagagcccctaatgtcctgatctataaggcgtctactttagcaaatggggtcccatcaaggttcagcggcagtggatctgggacagaattcactctcaccatcagcagcctgcagcctgatgactttgcaacttattactgccaacagtatcaaagttactggacgttcggcccagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1851 - DNA, 642 bp, Artificial Sequence
  chemically synthesized
gacatccagttgacccagtctccagccaccctgtctttgtctccaggggaaagagccaccctctcctgcaaggccagtcagagtgttagtagctacttagcctggtaccaacagaaacttggccaggctcccaggctcctcatctatgatgcatccaacagggccactggcatcccagccaggttcagtgccagtgggtctgggacagacttcactctcaccatcagcagcctgcagcctgaagatgttgcaacttattactgtcaaaagtataacagtccccctcggacgttcggccaggggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1852 - DNA, 645 bp, Artificial Sequence
  chemically synthesized
gaaacgacactcacgcagtctccaggcaccctgtctttgtctccaggggaaagggtcagcctttcctgcagggccagtcagaatgtttacagcaatttcttagcctggtatcaacagagacctggccaggctcccagtctcctcatctatggtgcctccagcagggccgctggcgtcccagacaggttcagtggcagtgggtctgggacagacttcgctctcaccatcagcagagtggagcctgaagattttgcagtctattactgtcaacaatatggaacctcaccgatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1853 - DNA, 657 bp, Artificial Sequence
  chemically synthesized
gaaattgtgctgactcagtctccacgctcctcacccgtcacccttggacagccggcctccatctcctgtaggtctagtcaaagtctcgaacacggtgatggaaacacgtacttgagttggcttcagcagaggccaggccagcctccaagactcctgatttataaggtttctaaccggttgtctggggtcccagacagattcagtggcagtggggcagggactgatttcacactgaaaatcagcagggtggaagctgaggatgtcggggtttattactgcatgcaaggtatatactggcctcgaaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1854 - DNA, 648 bp, Artificial Sequence
  chemically synthesized
gaaacgacactcacgcagtctccagtcaccctgtctttgtctccaggggacagagccaccctctcttgcagggccagtcagagtgttagcagcacctccttagcctggtaccagcacaaacctggccaggctcccaggctcctcatctatggtgcatccaggagggccactggcatcccagacaggttcagtggcagtgggtctgggacagacttcactctcaccatcaacagactggagcctgaagattttgcagtgtattactgtcagcactatggtagttcacctccaatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1855 - DNA, 645 bp, Artificial Sequence
  chemically synthesized
gaaacgacactcacgcagtctccagccaccctgtctgtgtctccaggggaaagagccaccctctcctgcagggccagtcagagtgttggcagcaaattagcctggtaccagcagaaacctggccaggctcccaggctcctcatctatggtgcatccaccagggccactggtgtcccagtccggttcagtggcagtgggtctgggacagaattcactctcaccatcagcagcctgcagtctgaagattttgcagtttattactgtcagcagtataataactggcccccgatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1856 - DNA, 657 bp, Artificial Sequence
  chemically synthesized
gaaattgtgttgacgcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtgtattactgcatgcaaactcttcaaactccgctcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1857 - DNA, 663 bp, Artificial Sequence
  chemically synthesized
gatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtactccgtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1858 - DNA, 657 bp, Artificial Sequence
  chemically synthesized
gatattgtgatgacccacactcccctctctctgtccgtcacccctggacagccggcctccatctcctgcaagtctagtcagagcctcctgggtggtgatggaaagacctatttgtattggtacctgcagaagccaggccagcctccacagctcctgctctatgaagtttccaaccgattctctggagtgccagataggttcagtggcagcggggcagcgacagatttcacactgaaaatcagcagggtggaagctgaggatgtcggggtttattactgcatgcaatctacacaatttccgtggacgttcggccaagggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1859 - DNA, 648 bp, Artificial Sequence
  chemically synthesized
gaaacgacactcacgcagtctccaggcaccctgtctttgtctgcaggggaaagagccaccctctcctgcagggccagtcagagtgttagcagcagctacttagcctggtaccagcagaaacctggccaggctcccaggctcctcatctatgctgcatcctacagggccactggcatcccagacaggttcagtggccgtgggtctgggacagagttcactctcaccatcagcagcctgcagtctgaagattttgcagtttattactgtcagcagtataataactggcctcccatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1860 - DNA, 642 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccagccaggttcagtggcagtgggtctgggacagagttcactctcaccatcagcagcctgcagtctgaagattttgcagtttattactgtcagcactataataactggcctcataccttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1861 - DNA, 642 bp, Artificial Sequence
  chemically synthesized
gaaacgacactcacgcagtctccaggcaccctgtctttgtctccaggggaaagagccaccctctcctgcagggccagtcagagtgttagcagcaactccttagcctggtaccagcagaaacctggccaggctcccaggctcctcatctatggtgcatccagcagggcctctggcatcccagacaggttcaatggcagtgggtctgggacagacttcactctcaccatcaataggctggagcctgaagactttgcagtgtattactgtcagcagtatggtaactcacagaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1862 - DNA, 642 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccccggacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1863 - DNA, 657 bp, Artificial Sequence
  chemically synthesized
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacattggcctcggactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1864 - DNA, 642 bp, Artificial Sequence
  chemically synthesized
gacatccagatgacccagtctccttccaccctgtctgcatctgtaggagacagagtcaccatcacttgccgggccagtcagagtattagtaggtggttggcctggtatcagcagaagccagggaaagcccctaagctcctgatctataaggcgtctactataaaaagtggggtcccatcaagattcagcgccagtggatctgggacagaattcactctcaccatcagcagcctgcagcctgaagattttgcaacttattactgccaacactataaaagtgattcccggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1865 - DNA, 639 bp, Artificial Sequence
  chemically synthesized
gatgttgtgatgactcagtctccatcctccctcgctgcatctgttggagacagaattaccatcacttgccggccaagtcaggacataggcacttatttaaattggtatcaacagaaggcaggggaagcccctaagctcctcatctatgctgcctccaatctgcacagtggcgtctcatcaaggttcagaggcgttgggtctgggacacaattcactctcaccatcagcagtctgcaacctgaggattttgcaacttactactgtcatcagagttacggtcctcggacattcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1866 - DNA, 645 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctccgatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1867 - DNA, 645 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcagggtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1868 - DNA, 636 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcgttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1869 - DNA, 642 bp, Artificial Sequence
  chemically synthesized
gaaattgtgttgacacagtctccttccaccctgtctgcatctgtaggggacagagtcaccatcacttgccgggccagtcagagtattagtagctgcttggcctggtatcagcagaaaccagggaaagcccctaagctcctgatctatgctgcatccactttgcaaagtggggtcccatcaaggttcagcggcagtggatctgggacagaattcactctcacaatcagcaccctgcagcctgaagattttgcaacttattactgtcaacagcttaatagttaccctcagacgttcggccaagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1870 - DNA, 657 bp, Artificial Sequence
  chemically synthesized
gatattgtgatgacccacactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1871 - DNA, 645 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtataataactggcctctcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1872 - DNA, 660 bp, Artificial Sequence
  chemically synthesized
gacatccagttgacccagtctcccgactccctggctgtgtctctgggcgagagggccaccatcaactgcacgtccagccagagtgttttatacagctccaacaataagaactacatagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattattatattcctcggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1873 - DNA, 654 bp, Artificial Sequence
  chemically synthesized
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcccccggggtccctgacaggttcagtggcagtggatcaggcacagattttacactgaaaatcagcagagtggaggctgaggatgttggggtttattactgcatgcaagctctacaaactcggacattcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1874 - DNA, 645 bp, Artificial Sequence
  chemically synthesized
gaaacgacactcacgcagtctccaggcaccctgtctttgtctccaggggaaagagccaccctctcctgcagggccagtcagagtcttaccagcagctacttagcctggtaccagcagaaacctggccaggctcccagactcctcatctatcgtgcatccagcagggccactggcatcccagaccggttcagtggcagtgggtctgggacagacttcactctcaccatcagcagactggagcctgaagattttgcagtttattactgtcagcagtatggtagttcacctaacaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1875 - DNA, 660 bp, Artificial Sequence
  chemically synthesized
gaaattgtgttgacacagtctccactctccctgcccgtcacccttggacagccggcctccatctcctgcaggtctagtcaaagcctcgtacacagtaatggacacacctacttgagttggtttcagcagaggccaggccaatctccaaggcgcctcatttatgaggtttctaaccgggactctggtgtcccagacagattcagcggcagtgggtcaggcactgatttcacactaagaatcagcagggtggaggctgaggatgttggggtttattactgcttgcaaggaacacactggccccccctcactgtcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1876 - DNA, 642 bp, Artificial Sequence
  chemically synthesized
gatgttgtgatgactcagtctccagccaccctgtctttgtctccaggggaaagagccaccctctcctgcagggccagtcagagtgttggcagcgacttagcctggtaccagcagaaacctggccaggctcccaggctcctcatctaccgtgcatccaccagggccgctggtatcccagccaggttcagtggcagtgggtctgggacagacttcactctcaccatcagcagactggagcctgaagattttgcagtgttttactgtcagcagtatggtagatcaccgtacacttctggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1877 - DNA, 660 bp, Artificial Sequence
  chemically synthesized
gatattgtgatgacccacactccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1878 - DNA, 657 bp, Artificial Sequence
  chemically synthesized
gaaattgtgatgacgcagtctccactctccctgtccgtcacccctggagagccggcctccatctcctgcaggtctagtcagagcctcctacatagtagtggatacaactatttggattggtacctgcagaagccaggccagtctccacagctcctgatctatttgggttctactcgggcctccggggtccctgacaggttcagtggcagtggatcaggcacagattttacactgaaaatcagcagagtggaggctgaggatgttggggtttattattgcatgcaaggtctacaaattccgctcactttcggcggagggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1879 - DNA, 657 bp, Artificial Sequence
  chemically synthesized
gatattgtgatgacccacactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttccgtggacgttcggccaagggaccaaggtggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1880 - DNA, 639 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggcatcccagccaggttcagtggcagtgggtctgggacagagttcactctcaccatcagcagcctgcagtctgaagattttgcagtttattactgtcagcagtataataactggcctcggttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1881 - DNA, 642 bp, Artificial Sequence
  chemically synthesized
gatgttgtgatgactcagtctccttccaccctgtctgcatctgtaggggacagagtcaccatcacttgccgggccagtcagactattaatagttggttggcctggtatcagcagaaaccagggaaggcccctaagctcctcatctctagggcgtctcgtttagaaagtggggtcccatcaaggttcagcggcagtgcatctggcacagaatacattctcaccatcaacagcctgcagcctgatgattttgcaatgtacttctgccatcaatataatagttattctcccacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1882 - DNA, 645 bp, Artificial Sequence
  chemically synthesized
gaaacgacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagccaggttcagtggcagtgggtctgggacagacttcactctcaccatcagcagcctagagcctgaagattttgcagtttattactgtcagcagcgttacaactggcctatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1883 - DNA, 642 bp, Artificial Sequence
  chemically synthesized
gaaattgtgttgacgcagtctccagccaccctgtctttgtctccgggggaaacagccaccctctcctgcagggccagtcagactattggtcccaagtccttcggctggtaccaacagagacctggccaggctcccaggctcctcatctatgactccaacagggccactggcatcccagccaggttcagtggcagtgggtctgggacagacttcactctcaccatcagcagcctagagcctgaagattttgcagtttattactgtcagcagcgtagcaggtggcctctcactttcggccctgggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1884 - DNA, 657 bp, Artificial Sequence
  chemically synthesized
gatgttgtgatgactcagtctccactctccctgcccgtcacccttggacagccggcctccatctcctgcaggtctagtcaaagcctcgtgtacagtgatggaaacacctacttgtattggtttcagcagagggcaggccaatctccaaggcgcctgatttataaggtttctaagcgggactctggggtcccagacaggttcagcggcagtgggtcaggcactgatttcacactgaaaatcagcagggtggaggctgaggatgttggaatttattactgcgtgcaaggtagacactggccgtacactcttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1885 - DNA, 645 bp, Artificial Sequence
  chemically synthesized
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccaacagggccactggcatcccagccaggttcagtggcagtggatctgggacagaattcactctcaccatcagcagcctgcagcctgatgattttgcaacttattactgccaacagtataatagttattcaaggacgttcggccaggggaccaaagtggatatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1886 - DNA, 642 bp, Artificial Sequence
  chemically synthesized
gatgttgtgatgactcagtctccttccaccctgtctgcatctgtgggagacagagtcaccatcacttgccgggccagtcagagtattactacctggttggcctggtctcagcagcaaccagggaaagcccctaagctcctcatctataaggcctctagtttaacaagtggggtcccatcaaggttcagcggcagtggatctgggacagagttcactctcaccatcagcagcctgcagcctgatgattttgcaagttattactgccatcattataatggtgcttctcgtatgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1887 - DNA, 639 bp, Artificial Sequence
  chemically synthesized
gaaacgacactcacgcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctttcttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1888 - DNA, 642 bp, Artificial Sequence
  chemically synthesized
gaaacgacactcacgcagtctccagccaccctgactttgtctccaggggaaagagtcaccctctcctgcagggccagtcagagtattggcacttacgtcgcctggtatcagcagaaacctggccaggctcccagattcctcatctatgattcatcgaatagggccactggcatcccagccaggttcagtggtagtgggtctgggacagacttcactctcacgatcagcagcctggagcctgaagattttgcattttattactgtcaacagcgtgccgagtggcctctcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1889 - DNA, 648 bp, Artificial Sequence
  chemically synthesized
gatgttgtgatgactcagtctccaggcaccctgtctttgtctccaggggaaagagccactctctcctgcagggccagtcagagtgttaatagcggctacttagcctggtaccagcagaaacctggccaacctcccagactcctcatctctggtgtttccaccagggccactggcatcccagacaggttcagtggcagtgggtctgggacagacttcactctcaccatcagcagactggagcctgaagattttgcagtgtattactgtcaggagtatggtaactcagctatgtacaattttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1890 - DNA, 645 bp, Artificial Sequence
  chemically synthesized
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcccttcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1891 - DNA, 645 bp, Artificial Sequence
  chemically synthesized
gatgttgtgatgactcagtctccaggcaccctgtctttgtctccaggggaaagagccaccctctcctgcagggccagtcagagtgttagcagcagctacttaggctggtatcagcagaaatccggccaggctcccaggctcctcatctatggtgcatccagcagggccactgacatcccagacaggttcagtggcagtgggtctgggacagacttcactctcaccatcagcaaactggaggcagaagattctgcagtgtattactgtcagcagtatggtatctcacctctcgcgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1892 - DNA, 645 bp, Artificial Sequence
  chemically synthesized
gaaacgacactcacgcagtctccagccaccctgtctgtgtctccaggggagagagccaccctctcctgcagggccagtcagagtattagcaacaacttagcctggtaccagcagaaacctggccaggctcccaggctcctcatctatggtacatccaccagggccactggtatcccagccaggttcagtggcagtgggtctgggacagagttcactctcaccatcagcagcctgcagtctgaagattttgcagtttattactgtcagcagtataatttctggccttcgatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1893 - DNA, 642 bp, Artificial Sequence
  chemically synthesized
gaaacgacactcacgcagtctccaggcaccctgtctttgtctccaggggaaagagccaccctctcctgcagggccagtcagagtgttagcagcagctccttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacagaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1894 - DNA, 657 bp, Artificial Sequence
  chemically synthesized
gatgttgtgatgactcagtctccactctccctgcccgtctcccttggacagccggcctccatctcctgcaggtctaatcaaagcctcgtatacagtgatggaggcacctacttgaattggtttcagcagagggcaggccagtctccaaggcgcctagtttataaggtttctaaccgggactctggggtcccagacagattcagcggcagtgggtcaggcactgatttcacactgagaatcagcagggtggaggctgaggatgttggggtttattactgcatgcaagggacacactggccgtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1895 - DNA, 642 bp, Artificial Sequence
  chemically synthesized
gacatccagttgacccagtctccatcctccctgtctgcatctgtaggagacagagtcaccgtcacttgccgggcaagtcagagcattagcagctatttaaattggtatcagcagaaaccagggaaagcccctcaactcctgatctacgatgcatccaatttggaaacaggggtcccctcaaggttcagtggaagtggatctgggacagattttactttcaccatcagcagcctgcagcctgaagattttgcaacatattactgtcagcagtttgataatgtcccagtcactttcggcggagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1896 - DNA, 657 bp, Artificial Sequence
  chemically synthesized
gaaattgtgctgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcgaacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1897 - DNA, 645 bp, Artificial Sequence
  chemically synthesized
gatgttgtgatgactcagtctccagccaccctgtctgtgtctccaggggaaagagccaccctctcctgcagggccagtcagagtgttagcagcaacttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtagctcatccatgtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1898 - DNA, 642 bp, Artificial Sequence
  chemically synthesized
gatgttgtgatgactcagtctccatcctccctgtctgcatctgtgggggacagcgtcgccatcacttgccgggcaagtcagagcattagcaactatttaaattggtatcagcagagaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactcctgtcaacagagttacattaccccgtggacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1899 - DNA, 642 bp, Artificial Sequence
  chemically synthesized
gatgttgtgatgactcagtctccaggcaccctgtctttgtctccaggggaaagagccaccctctcctgcagggccagtcagagtgttagcaccctcttagcctggtaccaacagaaacctggccaggctcccaggctcctcatctatgatgcatccaacagggccactggcatcccaggcaggttcagtgccagtgggtctgggacagacttcagtctcaccatcagcagcctagagactgaagattctgcagtttattactgtcagcaccgttacgtgtggccgttcactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1900 - DNA, 642 bp, Artificial Sequence
  chemically synthesized
gacatccagatgacccagtctccatcctccctgtctgcatctgtaggagacagagtcaccatcacttgccgggcaagtcagggcattagaaatgatttaggctggtatcagcagaaaccagggaaagcccctaagcgtctgatctatggtgcatccagtttgcaaagtggagtcccatcaaggttcagcggcagtggatctgggacagaattcactctcacaatcaggagcctgcagcctgaagattttgcaacttattattgtctacagcataattcctaccctcgaacattcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1901 - DNA, 642 bp, Artificial Sequence
  chemically synthesized
gatgttgtgatgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgtggacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1902 - DNA, 657 bp, Artificial Sequence
  chemically synthesized
gatgttgtgatgactcagtctccgctctccctgcccgtcacccttggacaggcggcctccatctcctgcaggtctagtcatagcctcacaactactgatggacgtacttacgtggcttggtttcagcagaggccaggccaatctccaaggcgccttctttatgaggtttctaagcgggactctggggccccagacagattcagcggcagtgggtcaggcactgatttcactctgaaaatcagcagggtggaggctgacgatgttggaatttatcattgcatgcaaggaacacatgggcctcacacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1903 - DNA, 645 bp, Artificial Sequence
  chemically synthesized
gaaacgacactcacgcagtctccagccaccctgtctgtgtctccaggggaaagagccaccctctcctgcagggccagtcaaagtgttaccagcaacttagcctggtaccagcagaaacctggccaggctcccaggctcctcatctatggtgcatccaacagggccactggtatcccagccaggttcagtgtcagtgggtctgggacagacttcactctcaccatcagcagactggagcctgaagattttgcagtgtattactgtcagcagtatggtagtccacctccgaccaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1904 - DNA, 645 bp, Artificial Sequence
  chemically synthesized
gatgttgtgatgactcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacgtcggacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1905 - DNA, 645 bp, Artificial Sequence
  chemically synthesized
gaaacgacactcacgcagtctccaggcaccctgtccttgtctccaggggaaagagccaccctctcctgcagggccagtcagagtgttttcaacaactacttagcctggtaccaacagagacctggccaggctcccaggctcctcatctatggtgcatccagcagggccactggcatcccagacaggttcagtggcggtgggtctgggacagacttcactctcaccatcagcagactggagcctgaagatttcgcagtgtattgctgtcagcagtatggtagttcaccgatcaccttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1906 - DNA, 645 bp, Artificial Sequence
  chemically synthesized
gaaattgtgctgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagactggagcctgaagattttgcagtgtattactgtcagcagtatggtagctcactcaggtacacttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1907 - DNA, 657 bp, Artificial Sequence
  chemically synthesized
gaaattgtgctgactcagtctccagactccctggctgtgtctctgggcgagagggccaccatcaactgcaagtccagccagagtgttttatatgattccaacagtaagaactacttaagttggtatcagcagaaaccaggccagcctcctaagttgctcatttcctgggcgtctacccgggggtccggggtccctgaccgattcagtggcagcgggtctgggacagatttcactctcaccatcagcagcctgcaggctgaagatgtggcagtttattactgtcagcaattttatggtattccccacttcggccaagggacacgactggagattaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1908 - DNA, 645 bp, Artificial Sequence
  chemically synthesized
gatgttgtgatgactcagtctccagccaccctgtctttgtctccaggggaaagagccaccctctcctgcagggccagtcagagtgttggtaccaatttagcctggtaccagcagaaacctggccaggctcccaggctcctcatctatgatgcatccaacagggccactggcatcccagccaggttcagtggcagtgggtctgggacagagttcactctcaccatcagcagcctgcagtctgaagattttgcagtttattactgtcagcagtataataactggcctccgataactttcggcggagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1909 - DNA, 657 bp, Artificial Sequence
  chemically synthesized
gatgttgtgatgactcagtctccactctccctgcccgtcacccttggacagccggcctccatctcctgcaggtctagtcaaagcctcgtatacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaaggtacacaatttcctcaaacgttcggccaagggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1910 - DNA, 648 bp, Artificial Sequence
  chemically synthesized
gaaattgtgctgactcagtctccaggcaccctgtctttgtctccaggggaaagagccaccctctcctgcagggccagtcagagtgtaataagcaggtacttagcctggtatcagcagaaacctggccaggctcccaggctcctcatccatggtgcatccaccagggccactggcatcccagacaggttcagtggcagtgggtctgggacagacttcactctcaccatcagcagactggagcctgaagactttgcagtgtattactgtcagcagtatggtagctcacctccgtacacttttggccaggggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1911 - DNA, 642 bp, Artificial Sequence
  chemically synthesized
gacatccagttgacccagtctccttccaccctggctgcatctgtaggagacagagtcaccatcacttgccgggccagtcagagtattagtagctggttggcctggtatcagcagaaaccagggaaagcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataatagttattcggggacgttcggccaagggaccaaggtggaaatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1912 - DNA, 642 bp, Artificial Sequence
  chemically synthesized
gatgttgtgatgactcagtctccagccatcctgtctgtgtctccaggggaaagagccaccctctcctgcagggccagtcagagtgttagtagcagcttagcctggtaccagcagaaacctggccagcctcccaggctcctcatctatggtgcctccaccagggccactgctatcccagccaggttcagtggcagtgggtctgggacagagttcactctcaccatcagcagcctgcagtctgaagattttgcagtttattactgtcagcgctatgataactggcctcccctttttggccaggggaccaagctggagatcaaacgtactgtggctgctccctccgtgttcatttttcctccgtcggacgaacagctgaagtccggaaccgcgtccgtggtctgtctcctgaacaacttctatccgcgcgaggcgaaagtgcagtggaaggtcgacaacgcactgcagtcgggaaactcccaggaatcggtgaccgagcaggactcgaaggactcaacctactcattgtcctccaccctcaccctgagcaaggccgattacgagaagcataaggtctacgcctgcgaagtgacccaccagggcctgagcagcccagtgacgaagtccttcaaccggggagaatgc

SEQ ID NO: 1913 - protein, 451 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGSLSRSGWYAGLFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1914 - protein, 451 aa, Artificial Sequence
  chemically synthesized
QITLKESGGGVVQPGRSLRLSCAASGFTFSSYSMNWVRQAPGKGLQWVAIISDDGSKSYYADSVQGRFTISRDNSRNTVFLQMNSLRAEDTAMYYCARDRGTKWNQLNDVFDMWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1915 - protein, 450 aa, Artificial Sequence
  chemically synthesized
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGRGYSSSRLYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1916 - protein, 447 aa, Artificial Sequence
  chemically synthesized
QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1917 - protein, 446 aa, Artificial Sequence
  chemically synthesized
EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1918 - protein, 443 aa, Artificial Sequence
  chemically synthesized
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEYFYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1919 - protein, 450 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVNPGSYTREVSNFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1920 - protein, 448 aa, Artificial Sequence
  chemically synthesized
QVQLQQSGPELVKPSQTLTLTCGISGDSVSSNSVTWNWVRQSPSRGLEWLGRTYYRSQWYYNYAVSVKSRITISPDTSKNQFSLQLNSVTPEDTAVYYCATRGHNYGVDYWGPGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1921 - protein, 447 aa, Artificial Sequence
  chemically synthesized
QVQLVQSGGGLVKPGGSLRLSCAASGFTFSNAWMSWVRQAPGKGLEWVCRIKSKTDGETTDYAAPVKGRFTISRDDSKNTLYLQMNSLKTEDTAVYHCTTGVGWSPFQYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1922 - protein, 454 aa, Artificial Sequence
  chemically synthesized
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRDDKIAAAGFTYWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1923 - protein, 445 aa, Artificial Sequence
  chemically synthesized
QVQLVQSGAEVKKPGASVKVSCKASGYTFAAYYLHWVRQAPGQGLEWMGRISPGNGVTSYAQKFQGRVTMTGDTSINTVYMQLNNLISGDTAVYYCAREAADDPFDHWGQGALVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1924 - protein, 442 aa, Artificial Sequence
  chemically synthesized
EVQLVQSGGGVVQPGRSLTLSCAASGFTFSSHLMHWVRQAPGKGLEWVAVISYDGTSKYYGDSVKGRFTISRDNSKNTLYLQMNSLRAEDTAIYYCAKADYKYDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1925 - protein, 452 aa, Artificial Sequence
  chemically synthesized
EVQLVQSGGGLVKPGGSLRLSCTASGFTFGDYAMSWVRQAPGKGLEWVGFIRSKAYGGTTEYAASVKGRFTISRDDSKSIAYLQMNSLKTEDTAVYYCTTHRRPIYDILTGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1926 - protein, 448 aa, Artificial Sequence
  chemically synthesized
QLQLQESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTREDTMVRGVIPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1927 - protein, 455 aa, Artificial Sequence
  chemically synthesized
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARDRRYYDSSGYYPAYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1928 - protein, 449 aa, Artificial Sequence
  chemically synthesized
EVQLVQSGGGLVKPGGSLRLSCAASGFTFSSYSMNWVRQAPGKGLEWVSYISSSGSYTNYADSVKGRFTISRDNAKNSLYLQINSLRAEDTAIYYCARDGGYDSSGFHFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1929 - protein, 456 aa, Artificial Sequence
  chemically synthesized
QVQLQQSGPGLVKPSQTLSLTCAISGDSVSNNRAAWNWIRQSPSRGLEWLGRTYYRSKWYNEYAVSVKSRITINPDTSKNQFSLQLNSMTPEDSAVYYCAILPSSGYLQDHHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1930 - protein, 449 aa, Artificial Sequence
  chemically synthesized
EVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARAAVGDGYSYGRLDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1931 - protein, 454 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPSYYYDSSGYFTWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1932 - protein, 449 aa, Artificial Sequence
  chemically synthesized
EVQLVQSGAEVKKPGASVKVSCKASGYTFTSYGISWVRQAPGQGLEWMGWIIPIFGIANYAQKFQGRVTITADKSTSTAYMELSSLRSEDTAVYYCARELYNYGSKDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1933 - protein, 450 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGTWDTAMVTGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1934 - protein, 451 aa, Artificial Sequence
  chemically synthesized
EVQLVQSGAEVKKPGESLKISCKGSGYSFTSYWIAWVRQMPGKGLEWMGVIYPGDSDTRYSPSFQGQVTISADKSINTAYLQWSSLKASDTAMYYCARPHYDILTGSRAPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1935 - protein, 447 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1936 - protein, 450 aa, Artificial Sequence
  chemically synthesized
EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1937 - protein, 444 aa, Artificial Sequence
  chemically synthesized
QITLKESGGGLVQPGGSLRLSCTVSGFTFSNNWMTWVRQTPGKGLEWVANIKQDGTEKHYVDSVKGRFTISRDNAENSLYLQMNSLRGEDTAVYYCARNSQRSFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1938 - protein, 448 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGDPRGGILNYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1939 - protein, 452 aa, Artificial Sequence
  chemically synthesized
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSPWGELSLYQGAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1940 - protein, 448 aa, Artificial Sequence
  chemically synthesized
QITLKESGGGLVQPGRSLRLSCAASGFTFDDYAMHWVRQAPGKGLEWVSAISGSGGSTYYADSVKGRFTISRDNSKNTLYLQMNSLRAEDTAVYYCAKDNDFWSGKVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1941 - protein, 448 aa, Artificial Sequence
  chemically synthesized
EVQLVQSGGGLVQPGGSLRLSCAASGFTFSSYSMNWVRQAPGKGLEWVSYISSTSSTIYYADSVKGRFTISRDNSKNMLFLQMNSLRAEDTAVYYCAKEGGSGWRHYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1942 - protein, 450 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARDYCSSTSCQNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1943 - protein, 446 aa, Artificial Sequence
  chemically synthesized
QVQLVQSGGGLVQPGGSLRLSCAASGFTFSNYVMSWVRQAPGKGLEWVSAISGIGDTTYYADSVKGRFTISRDNAKNTLYLQMNSLRAEDTAVYYCARGRVAGDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1944 - protein, 450 aa, Artificial Sequence
  chemically synthesized
QLQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQGAAAGTLGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1945 - protein, 450 aa, Artificial Sequence
  chemically synthesized
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCTRGIYDSSGSSNPFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1946 - protein, 451 aa, Artificial Sequence
  chemically synthesized
EVQLVQSGAEVKKPGASVKISCEASGYTFTDYAIHWVRQAPGQRLEWMGWINAGDGGTKSSREFQGRVTITRDTSATTAYMEVSSLRSEDTAVYYCARGYCSGGSCPGTDFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1947 - protein, 449 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGVGGRDGYNFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1948 - protein, 446 aa, Artificial Sequence
  chemically synthesized
EVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARAPLAADGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1949 - protein, 449 aa, Artificial Sequence
  chemically synthesized
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARARGLQYLIWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1950 - protein, 450 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCASPGMVRGVITAPLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1951 - protein, 447 aa, Artificial Sequence
  chemically synthesized
EVQLVQSGGGLVKPGGSLRLSCAASGFTFSSYAISWVRQAPGQGLEWMGGIIPMYGTANYAQKFQGRVTITADESTSTAYMELSSLRSEDTALYYCAREAKWGMYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1952 - protein, 451 aa, Artificial Sequence
  chemically synthesized
EVQLVESGGGVVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1953 - protein, 445 aa, Artificial Sequence
  chemically synthesized
QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1954 - protein, 453 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1955 - protein, 450 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGTMVRGFGFNYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1956 - protein, 453 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAMIGPLPRLVGYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1957 - protein, 451 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPAPSWVKTRNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1958 - protein, 446 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREASSGWNWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1959 - protein, 451 aa, Artificial Sequence
  chemically synthesized
QVQLQESGPGLVKPSQTLSLTCAISGDSVSSNNAAWNWIRQSPSRGLEWLGRTFYRSKWYNDYAVSVKSRLTVNPDTSKNQFSLRLNSVSPEDTAVYYCARGGRYTKGGYFDDWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1960 - protein, 450 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRLDSSGRGGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1961 - protein, 454 aa, Artificial Sequence
  chemically synthesized
EVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKELVGTSSPYYYYYYGMDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1962 - protein, 445 aa, Artificial Sequence
  chemically synthesized
QLQLQESGGGLVQPGGSLRLSCAASGFTVSSNYMSWVRQAPGKGLEWVSVIYSGGSTYYADSVKGRFTISRDNSKNTLYLQMNSLRAEDTAVYYCARDYYYGSGSSPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1963 - protein, 452 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPYCSSTSCYPEWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1964 - protein, 454 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKLRGIDYYDSSGYQRGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1965 - protein, 446 aa, Artificial Sequence
  chemically synthesized
QVQLQESGPGLVKPSETLSLTCTVSGGSISSYYWSWIRQPPGKGLEWIGYIYYTGSTNYNPSLKSRVTISVDTSKNQFSLKLSSVTTADTAVYYCARGGRGDGAAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

(The sequence listing continues in the following parts.)

The invention claimed is:

1. An isolated antibody that binds to C-Type Lectin Domain Family 2 Member D (CLEC2D) or antigen-binding fragment thereof, comprising a heavy chain and a light chain, wherein the isolated antibody or antigen-binding fragment thereof comprises a variable heavy chain (HC) amino acid sequence and a variable light chain (LC) amino acid sequence selected from the group consisting of:
    a)
    HC amino acid sequence of SEQ ID NO: 56 and
    LC amino acid sequence of SEQ ID NO: 272,
    HC amino acid sequence of SEQ ID NO: 1 and
    LC amino acid sequence of SEQ ID NO: 217, and
    HC amino acid sequence of SEQ ID NO: 83 and
    LC amino acid sequence of SEQ ID NO: 299;
    b)
    HC amino acid sequence of SEQ ID NO: 44 and
    LC amino acid sequence of SEQ ID NO: 260,
    HC amino acid sequence of SEQ ID NO: 45 and
    LC amino acid sequence of SEQ ID NO: 261,
    HC amino acid sequence of SEQ ID NO: 77 and
    LC amino acid sequence of SEQ ID NO: 293,
    HC amino acid sequence of SEQ ID NO: 23 and
    LC amino acid sequence of SEQ ID NO: 239,
    HC amino acid sequence of SEQ ID NO: 73 and
    LC amino acid sequence of SEQ ID NO: 289, and
    HC amino acid sequence of SEQ ID NO: 7 and
    LC amino acid sequence of SEQ ID NO: 223;

c)
HC amino acid sequence of SEQ ID NO: 75 and
LC amino acid sequence of SEQ ID NO: 291, and
HC amino acid sequence of SEQ ID NO: 76 and
LC amino acid sequence of SEQ ID NO: 292;
d)
HC amino acid sequence of SEQ ID NO: 42 and
LC amino acid sequence of SEQ ID NO: 258,
HC amino acid sequence of SEQ ID NO: 43 and
LC amino acid sequence of SEQ ID NO: 259, and
HC amino acid sequence of SEQ ID NO: 72 and
LC amino acid sequence of SEQ ID NO: 288;
e)
HC amino acid sequence of SEQ ID NO: 64 and
LC amino acid sequence of SEQ ID NO: 280;
f)
HC amino acid sequence of SEQ ID NO: 50 and
LC amino acid sequence of SEQ ID NO: 266, and
HC amino acid sequence of SEQ ID NO: 36 and
LC amino acid sequence of SEQ ID NO: 252;
g)
HC amino acid sequence of SEQ ID NO: 80 and
LC amino acid sequence of SEQ ID NO: 296;
h)
HC amino acid sequence of SEQ ID NO: 33 and
LC amino acid sequence of SEQ ID NO: 249;
i)
HC amino acid sequence of SEQ ID NO: 24 and
LC amino acid sequence of SEQ ID NO: 240;
j)
HC amino acid sequence of SEQ ID NO: 59 and
LC amino acid sequence of SEQ ID NO: 275,
HC amino acid sequence of SEQ ID NO: 46 and
LC amino acid sequence of SEQ ID NO: 262,
HC amino acid sequence of SEQ ID NO: 57 and
LC amino acid sequence of SEQ ID NO: 273, and
HC amino acid sequence of SEQ ID NO: 47 and
LC amino acid sequence of SEQ ID NO: 263;
k)
HC amino acid sequence of SEQ ID NO: 74 and
LC amino acid sequence of SEQ ID NO: 290;
l)
HC amino acid sequence of SEQ ID NO: 25 and
LC amino acid sequence of SEQ ID NO: 241;
m)
HC amino acid sequence of SEQ ID NO: 60 and
LC amino acid sequence of SEQ ID NO: 276;
n)
HC amino acid sequence of SEQ ID NO: 28 and
LC amino acid sequence of SEQ ID NO: 244;
o)
HC amino acid sequence of SEQ ID NO: 4 and
LC amino acid sequence of SEQ ID NO: 220;
p)
HC amino acid sequence of SEQ ID NO: 6 and
LC amino acid sequence of SEQ ID NO: 222;
q)
HC amino acid sequence of SEQ ID NO: 21 and
LC amino acid sequence of SEQ ID NO: 237;
r)
HC amino acid sequence of SEQ ID NO: 63 and
LC amino acid sequence of SEQ ID NO: 279;
s)
HC amino acid sequence of SEQ ID NO: 87 and
LC amino acid sequence of SEQ ID NO: 245;
t)
HC amino acid sequence of SEQ ID NO: 35 and
LC amino acid sequence of SEQ ID NO: 251;
u)
HC amino acid sequence of SEQ ID NO: 81 and
LC amino acid sequence of SEQ ID NO: 297;
v)
HC amino acid sequence of SEQ ID NO: 61 and
LC amino acid sequence of SEQ ID NO: 277;
w)
HC amino acid sequence of SEQ ID NO: 76 and
LC amino acid sequence of SEQ ID NO: 292;
x)
HC amino acid sequence of SEQ ID NO: 58 and
LC amino acid sequence of SEQ ID NO: 274;
y)
HC amino acid sequence of SEQ ID NO: 71 and
LC amino acid sequence of SEQ ID NO: 287; and
z)
HC amino acid sequence of SEQ ID NO: 52 and
LC amino acid sequence of SEQ ID NO: 268, and
HC amino acid sequence of SEQ ID NO: 62 and
LC amino acid sequence of SEQ ID NO: 278.

2. The isolated antibody or antigen-binding fragment thereof of claim 1, wherein the isolated antibody or antigen-binding fragment thereof comprises a variable heavy chain (HC) amino acid sequence and a variable light chain (LC) amino acid sequence selected from the group consisting of:
a)
HC amino acid sequence of SEQ ID NO: 1 and
LC amino acid sequence of SEQ ID NO: 217;
b)
HC amino acid sequence of SEQ ID NO: 44 and
LC amino acid sequence of SEQ ID NO: 260,
HC amino acid sequence of SEQ ID NO: 45 and
LC amino acid sequence of SEQ ID NO: 261,
HC amino acid sequence of SEQ ID NO: 73 and
LC amino acid sequence of SEQ ID NO: 289, and
HC amino acid sequence of SEQ ID NO: 7 and
LC amino acid sequence of SEQ ID NO: 223;
c)
HC amino acid sequence of SEQ ID NO: 42 and
LC amino acid sequence of SEQ ID NO: 258, and
HC amino acid sequence of SEQ ID NO: 43 and
LC amino acid sequence of SEQ ID NO: 259;
d)
HC amino acid sequence of SEQ ID NO: 21 and
LC amino acid sequence of SEQ ID NO: 237;
e)
HC amino acid sequence of SEQ ID NO: 35 and
LC amino acid sequence of SEQ ID NO: 251; and
f)
HC amino acid sequence of SEQ ID NO: 58 and
LC amino acid sequence of SEQ ID NO: 274.

3. The isolated antibody or antigen-binding fragment thereof of claim 1, wherein the isolated antibody or antigen-binding fragment thereof comprises a heavy chain (HC) and a light chain (LC) frame-work region sequence of a heavy chain and a light chain germline family respectively, selected from the group consisting of:
a)
HC framework region of germline family IGHV1, IGHD6, or IGHJ4 and
LC framework region of germline family is IGKV3 or IGKJ5;

b)
HC framework region of germline family IGHV4, IGHD3, or IGHJ2 and
LC framework region of germline family IGKV3 or IGKJ4,
HC framework region of germline family IGHV4, IGHD3 or IGHJ5 and
LC framework region of germline family IGKV1 or IGKJ1,
HC framework region of germline family IGHV4, IGHD1, IGHJ4 and
LC framework region of germline family IGKV4 or IGKJ4, and
HC framework region of germline family IGHV4, IGHD3 or IGHJ4 and
LC framework region of germline family IGKV1 or IGKJ3;
c)
HC framework region of germline family EGHV3, IGHD5 or IGHJ4 and
LC framework region of germline family IGKV3 or IGKJ5;
d)
HC framework region of germline family IGHV5, IGHD5 or IGHJ4 and
LC framework region of germline family IGKV3 or IGKJ4;
e)
HC framework region of germline family EGHV1, IGHD5 or IGHJ4 and
LC framework region of germline family IGKV1 or IGKJ1; and
f)
HC framework region of germline family IGHV6, IGHD1 or IGHJ4 and
LC framework region of germline family IGKV3 or IGKJ1.

4. The isolated antibody or antigen-binding fragment thereof of claim 1, wherein the antibody or antigen-binding fragment thereof is afucosylated.

5. The isolated antibody or antigen-binding fragment thereof of claim 1, wherein the antibody or antigen-binding fragment thereof comprises an IgG1 Fc region, an IgG2 Fc region, an IgG4 Fc region, or an IgG1 N to A Fc region.

6. The isolated antibody or antigen-binding fragment thereof of claim 2, wherein the antibody or antigen-binding fragment thereof recognizes and binds to a conformational epitope of CLEC2D antigen, comprised of amino acid positions overlapping and/or non-overlapping with CD161 receptor-interacting amino acid residues.

7. The isolated antibody or antigen-binding fragment thereof of claim 2, wherein the antibody or antigen-binding fragment thereof comprises a variable heavy chain sequence and a variable light chain sequence that inhibit or abrogate or compete with another antibody that recognizes and binds to a conformational epitope of CLEC2D antigen, comprised of amino acid positions overlapping and/or non-overlapping with CD161 receptor-interacting amino acid residues.

8. The isolated antibody or antigen-binding fragment thereof of claim 2, wherein the antibody or antigen-binding fragment thereof comprises a variable heavy chain sequence and a variable light chain sequence that bind to a conformational epitope of CLEC2D antigen comprising any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

9. The isolated antibody or antigen-binding fragment thereof of claim 2, wherein the antibody or antigen-binding fragment thereof comprises a variable heavy chain sequence and a variable light chain sequence that inhibit or abrogate or compete with, the binding of another antibody to a conformational epitope of CLEC2D antigen comprising any of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 or a combination thereof.

10. The isolated antibody or antigen-binding fragment thereof of claim 2, wherein the antibody or antigen-binding fragment thereof comprises a variable heavy chain sequence and a variable light chain sequence that bind to a conformational epitope of CLEC2D antigen comprising at least one of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting non-linear scaffolds for CD161 receptor-interacting amino acid residues, thereby blocking the interaction between CLEC2D and CD161 receptors.

11. The isolated antibody or antigen-binding fragment thereof of claim 2, wherein the antibody or antigen-binding fragment thereof comprises a variable heavy chain sequence and a variable light chain sequence that bind to a conformational epitope of CLEC2D antigen comprising at least one of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95 of SEQ ID No: 886-920 and 930-1003, constituting allosteric and non-linear scaffolds for CD161 receptor non-interacting amino acid residues, thereby blocking the interaction between CLEC2D and CD161 receptors.

12. The isolated antibody or antigen-binding fragment thereof of claim 2, wherein the antibody or antigen-binding fragment thereof comprises a variable heavy chain sequence and a variable light chain sequence that when bound to CLEC2D selected from SEQ ID Nos: 886-920 and 930-1003, bind to at least one of the amino acid positions ARG175; TYR177; GLU179; ARG153; ARG84; HIS190; ARG101; GLU150; GLN154; THR152; GLN141; SER105; ASP107; ASP92; THR93; LYS94; LYS144; GLU138; CYS176; GLN139; ARG180; SER187; LYS181; PHE116; ASN95, independently or in combination to induce tumor killing or cytotoxicity.

13. The isolated antibody or antigen-binding fragment thereof of claim 1, wherein the antibody or antigen-binding fragment thereof binds to a second antigen.

14. The isolated antibody or antigen-binding fragment thereof of claim 13, wherein the second antigen is an immune checkpoint protein.

15. The isolated antibody or antigen-binding fragment thereof of claim 13, wherein the second antigen is a tumor antigen.

16. The isolated antibody or antigen-binding fragment thereof of claim 1, wherein the antibody or antigen-binding fragment thereof is for use in combination with an adoptive cell therapy comprising a chimeric antigen receptor T cell (CAR-T) or a chimeric antigen receptor NK cell (CAR-NK) directed against a second antigen.

17. The isolated antibody or antigen-binding fragment thereof of claim 16, wherein the second antigen is an immune checkpoint protein.

18. The isolated antibody or antigen-binding fragment thereof of claim 17, wherein the second antigen is a tumor antigen.

19. A pharmaceutical composition comprising the isolated antibody or antigen-binding fragment thereof of claim 1.

* * * * *